(12) United States Patent
Avila et al.

(10) Patent No.: US 12,460,201 B2
(45) Date of Patent: Nov. 4, 2025

(54) METHODS OF MULTIPLEXING CRISPR

(71) Applicant: Massachusetts Institute of Technology, Cambridge, MA (US)

(72) Inventors: Mariah Avila, Cambridge, MA (US); Kevin Michael Esvelt, Cambridge, MA (US); Elizabeth Ashton Strait, Cambridge, MA (US); Emma Chory, Cambridge, MA (US)

(73) Assignee: Massachusetts Institute of Technology, Cambridge, MA (US)

( * ) Notice: Subject to any disclaimer, the term of this patent is extended or adjusted under 35 U.S.C. 154(b) by 590 days.

(21) Appl. No.: 16/931,389

(22) Filed: Jul. 16, 2020

(65) Prior Publication Data
US 2021/0017516 A1    Jan. 21, 2021

Related U.S. Application Data

(60) Provisional application No. 62/874,719, filed on Jul. 16, 2019.

(51) Int. Cl.
  *C12N 15/10* (2006.01)
  *C12N 9/22* (2006.01)
  *C12N 15/11* (2006.01)

(52) U.S. Cl.
  CPC .......... *C12N 15/1086* (2013.01); *C12N 9/22* (2013.01); *C12N 15/11* (2013.01); *C12N 2310/20* (2017.05); *C12N 2800/80* (2013.01)

(58) Field of Classification Search
  CPC ...... C12N 15/1086; C12N 9/22; C12N 15/11; C12N 2310/20; C12N 2800/80
  USPC .......................................................... 506/2
  See application file for complete search history.

(56) References Cited

FOREIGN PATENT DOCUMENTS

| WO | 2017/049129 A3 | 3/2017 |
| WO | 2019/023291 A3 | 1/2019 |

OTHER PUBLICATIONS

Liao, C. et al. One-step assembly of large CRISPR arrays enables multi-functional targeting and reveals constraints on array design. bioRxiv: The preprint server for biology. 2018. p. 1-45. [retrieved on Jan. 24, 2023]. Retrieved from Internet: <URL: https://www.biorxiv.org/content/10.1101/31242> (Year: 2018).*

Shijin, Chen et al., "Cloning and functional verification of U6 and 7SK promoter of small RNA from Barna mini-pig in Guangxi." 34 (4): 445-53 (2012). Chinese reference with English abstract and Google machine translation.

East-Seletsky, Alexandra et al., "RNA Targeting by Functionally Orthogonal Type I-A CRISPR-Cas Enzymes." Molecular Cell, vol. 66, No. 3, (May 4, 2017), p. 373-383.

Fonfara, Ines, et al., "The CRISPR-associated DNA-cleaving enzyme Cpf1 also processes precursor CRISPR RNA 11." Nature, vol. 532, (Apr. 20, 2016), pp. 517-521.

Freitas, Ferdinando B., et al., "African Swine Fever Virus Encodes for an E2-Ubiquitin Conjugating Enzyme That Is Mono- and Di-Ubiquitinated and Required for Viral Replication Cycle." Scientific Reports 8 (1): 3471 (2018).

(Continued)

*Primary Examiner* — Aaron A Priest
*Assistant Examiner* — Randi Lynn Beil
(74) *Attorney, Agent, or Firm* — Pierce Atwood LLP

(57) ABSTRACT

The invention relates, in part, to methods and systems with which to identify guide RNAs (gRNAs) and methods and systems with which to prepare, design, and generate gRNAs and minimally repetitive arrays of gRNAs.

14 Claims, 26 Drawing Sheets

Specification includes a Sequence Listing.

(56) References Cited

OTHER PUBLICATIONS

Freitas, Ferdinando B., et al., "In Vitro Inhibition of African Swine Fever Virus-Topoisomerase II Disrupts Viral Replication." Antiviral Research 134 (Oct.): 34-41 (2016).

Gao, Linyi, et al. "Engineered Cpf1 variants with altered PAM specificities." Nature Biotechnology 35.8 (2017): p. 789-792.

International Search Report and The Written Opinion of the International Searching Authority from corresponding International patent application No. PCT/US2020/042423 dated Oct. 23, 2020.

Katoh, Kazutaka, et al., "MAFFT Multiple Sequence Alignment Software Version 7: Improvements in Performance and Usability." Molecular Biology and Evolution 30(4): 772-80 (2013).

Keita, Djeneba, et al., "Control of African Swine Fever Virus Replication by Small Interfering RNA Targeting the AI 5 IR and VP72 Genes." Anhviral Therapy 15 (5): 727-736 (2010).

Kiani, Samira, et al., "Cas9 gRNA engineering for genome editing, activation and repression." Nature Methods, vol. 12, No. 11, Sep. 7, 2015, pp. 1051-1054.

Kong, Qingran, et al. "Rosa26 Locus Supports Tissue-Specific Promoter Driving Transgene Expression Specifically in Pig." PloS One 9 (9): el 07945 (2014).

Li, Ping, et al., "Identification and Cloning of the Porcine ROSA26 Promoter and Its Role in Transgenesis." Transplantation Technology 2 (1): 1 (2014) p. 1-8.

Liao, Chunyu, et al., "Modular one-pot assembly of CRISPR arrays enables library generation and reveals factors influencing crRNA biogenesis." Nature Communications, vol. 10, No. 1, (Jul. 3, 2019).

Desinghaus, Lukas, et al., "Switching the activity of Cas12a using guide RNA strand displacement circuits." Nature Communications, vol. 10, No. 1, (May 7, 2019) p. 1-11.

Petkov, Stoyan, et al., "The Choice of Expression Vector Promoter Is an Important Factor in the Reprogramming of Porcine Fibroblasts into Induced Pluripotent Cells." Cellular Reprogramming 15 (1): 1-8 (2013).

Sanchez, Elena G., et al., "Phenotyping and Susceptibility of Established Porcine Cells Lines to African Swine Fever Virus Infection and Viral Production." Scientific Reports 7 (1): 10369 (2017) p. 1-13.

Swarts, Daan C., et al., "Structural Basis for Guide RNA Processing and Seed-Dependent DNA Targeting by CRISPR-Cas12a." Molecular Cell, vol. 66, No. 2, (Apr. 1, 2017), pp. 221-233.

Teng, Fei, et al., "Enhanced mammalian genome editing by new Cas12a orthologs with optimized crRNA scaffolds." Genome Biology, vol. 20, No. 1, (Feb. 5, 2019).

\* cited by examiner

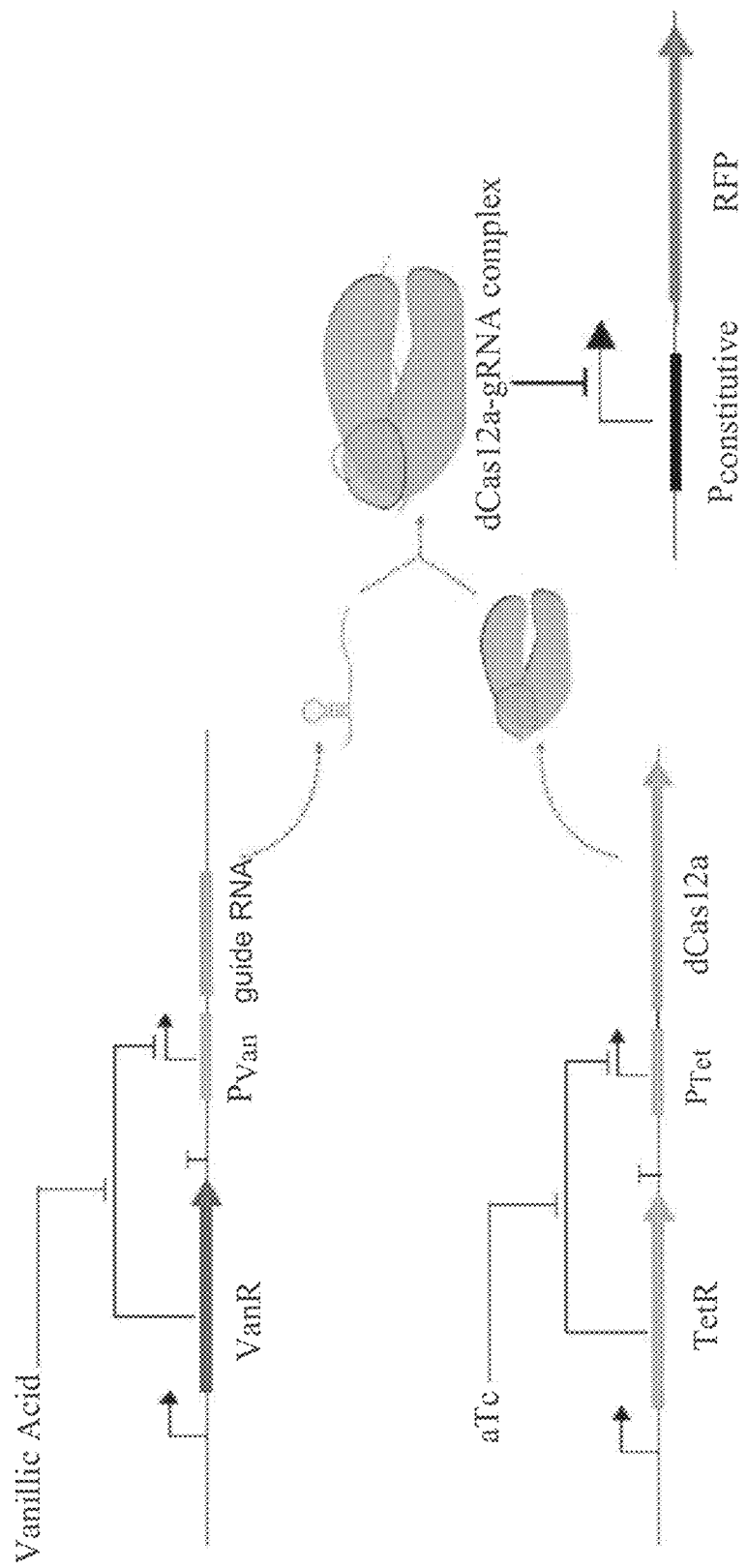

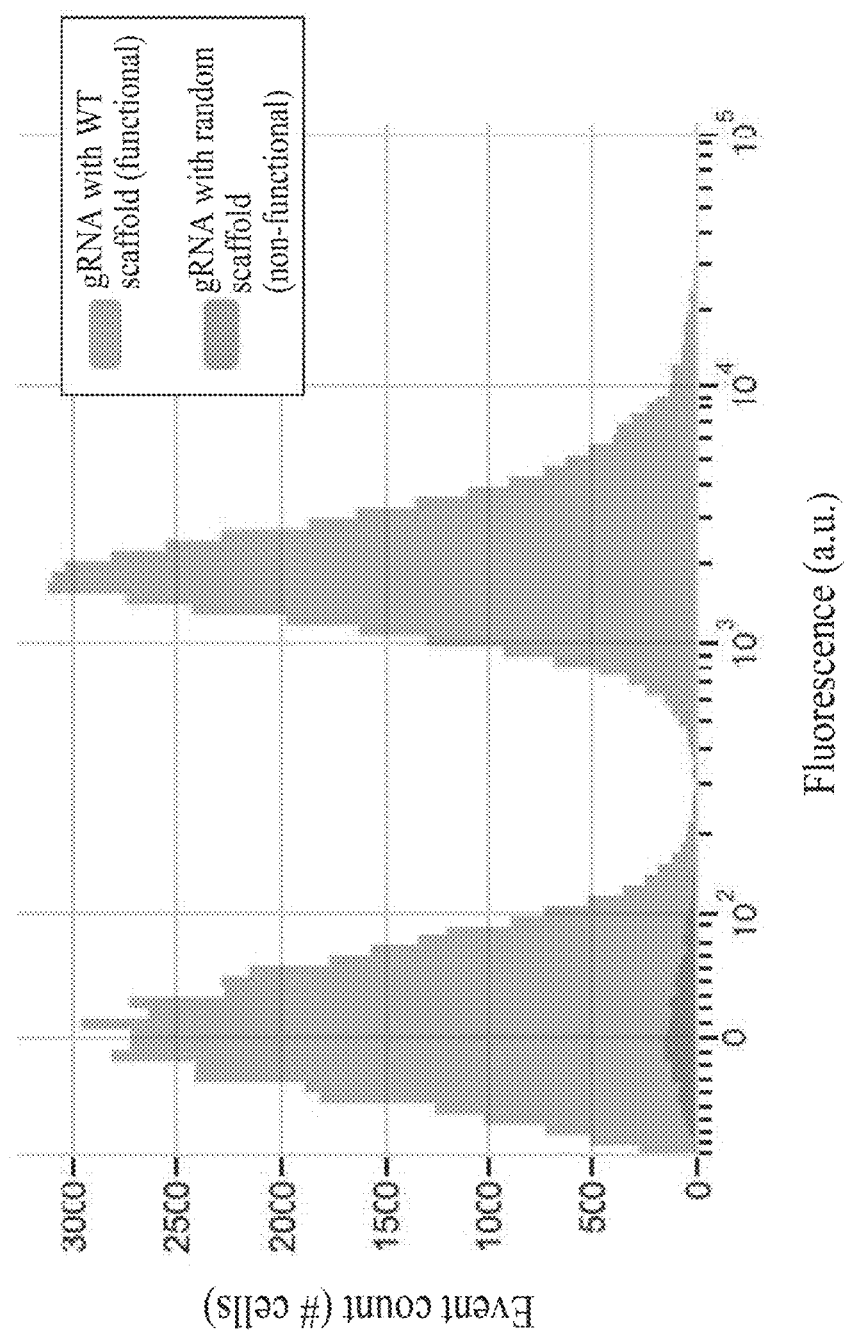

Fig. 4B

| | | A | C | G | T |
|---|---|---|---|---|---|
| Prestem | Naatttctactaagtgtagat | 11.57 | 8.25 | 6.55 | 7.89 |
| | tNatttctactaagtgtagat | 7.89 | 0.00 | 0.00 | 0.00 |
| | taNttctactaagtgtagat | 7.89 | 1.66 | 0.00 | 1.30 |
| | taaNtctactaagtgtagat | 0.92 | 2.38 | 0.99 | 7.89 |
| | taatNctactaagtgtagat | 0.00 | 0.00 | 0.00 | 7.89 |
| Left Stem | taattNtactaagtgtagat | 0.00 | 0.00 | 0.00 | 7.89 |
| | taatttNactaagtgtagat | 0.06 | 7.89 | 0.05 | 0.00 |
| | taatttcNctaagtgtagat | 0.04 | 0.00 | 0.00 | 7.89 |
| | taatttctNtaagtgtagat | 7.89 | 0.00 | 0.00 | 0.00 |
| | taatttctaNaagtgtagat | 0.03 | 7.89 | 0.00 | 0.44 |
| Loop | taatttctacNagtgtagat | 0.17 | 0.72 | 0.29 | 7.89 | ◀
| | taatttctactNgtgtagat | 7.89 | 7.78 | 9.10 | 7.17 |
| | taatttctactaNgtgtagat | 7.89 | 6.37 | 8.85 | 7.86 |
| | taatttctactaaNtgtagat | 9.32 | 4.94 | 7.89 | 8.77 |
| | taatttctactaagNtagat | 7.48 | 8.41 | 8.13 | 7.89 |
| Right Stem | taatttctactaagtNagat | 0.00 | 0.00 | 7.89 | 0.07 |
| | taatttctactaagtgNagat | 0.00 | 0.75 | 0.00 | 7.89 |
| | taatttctactaagtgtNat | 7.89 | 0.39 | 5.79 | 0.12 |
| | taatttctactaagtgtaNat | 0.00 | 0.07 | 7.89 | 0.00 |
| | taatttctactaagtgtagNt | 7.89 | 0.00 | 3.24 | 0.00 |
| | taatttctactaagtgtagaN | 0.00 | 0.00 | 0.00 | 7.89 |

Fig. 4C

| | AA | AC | AG | AT | CA | CC | CG | CT |
|---|---|---|---|---|---|---|---|---|
| taattNctactaagtgtagNt | 0.00 | 0.00 | 0.00 | 0.00 | 0.00 | 0.00 | 0.00 | 0.00 |
| taatttNtactaagtgtaNat | 0.00 | 0.00 | 0.06 | 1.22 | 0.00 | 0.07 | 7.89 | 0.00 |
| taatttcNactaagtgtaNgat | 0.04 | 0.00 | 0.00 | 0.00 | 0.00 | 0.00 | 0.00 | 0.00 |
| taatttctNcaagtgtaNagat | 0.00 | 0.75 | 0.00 | 7.89 | 0.00 | 0.00 | 9.26 | 0.00 |
| taatttctaNtaagtNtagat | 0.00 | 0.00 | 0.03 | 0.00 | 0.00 | 0.00 | 7.89 | 0.07 |

| | GA | GC | GG | GT | TA | TC | TG | TT |
|---|---|---|---|---|---|---|---|---|
| taattNctactaagtgtagNt | 0.00 | 0.00 | 0.00 | 0.00 | 7.89 | 0.00 | 3.24 | 0.00 |
| taatttNtactaagtgtaNat | 0.00 | 0.00 | 0.05 | 0.00 | 0.00 | 0.00 | 0.00 | 0.00 |
| taatttcNactaagtgtaNgat | 0.00 | 1.68 | 0.00 | 0.00 | 7.89 | 0.39 | 5.79 | 0.12 |
| taatttctNcaagtgtaNagat | 0.00 | 8.25 | 0.00 | 0.00 | 0.00 | 0.00 | 0.00 | 0.00 |
| taatttctaNtaagtNtagat | 0.00 | 0.00 | 0.00 | 0.00 | 0.00 | 0.00 | 0.44 | 0.00 |

| SEQ ID NO | Position in gRNA scaffold | | | | | | NOTES |
|---|---|---|---|---|---|---|---|
| | first | prestem | left stem | loop | right stem | final | |
| 32 | N | aatt | tctac | taagt | gtaga | t | prestem mutations |
| 33 | N | catt | tctac | taagt | gtaga | t | |
| 34 | N | actt | tctac | taagt | gtaga | t | |
| 35 | N | cctt | tctac | taagt | gtaga | t | |
| 36 | N | aatt | tctac | caagt | gtaga | t | first base loop is C |
| 37 | N | aatt | tctac | tNagt | gtaga | t | 2nd base loop is anything |
| 38 | N | aatt | tctac | taNgt | gtaga | t | 3rd base loop is anything |
| 39 | N | aatt | tctac | taaNt | gtaga | t | 4th base loop is anything |
| 40 | N | aatt | tctac | taagN | gtaga | t | 5th base loop is anything |
| 41 | N | aatt | tctac | taagt | gtagG | t | 1st pair is wobble |
| 42 | N | aatt | tctac | taagt | gtGga | t | 3rd pair is wobble |
| 43 | N | aatt | tAtac | taagt | gtaTa | t | 2nd pair is A-T |
| 44 | N | aatt | tctCc | taagt | gtaGg | t | 4th pair is C-G |
| 45 | N | aatt | tctGc | taagt | gtagG | t | 4th pair is G-C |
| 46 | N | aatt | tcGac | taagt | gtCga | t | 3rd pair is G-C |
| 47 | N | aatt | tctac | taagt | gCaga | t | 4th pair is A-C |
| 48 | N | aatt | tctaT | taagt | gtaga | t | 5th pair is wobble |
| 49 | N | aatt | tAtac | TACG | gtaTa | t | tAtac stem mutation with different 4-loops |
| 50 | N | aatt | tAtac | TATC | gtaTa | t | |
| 51 | N | aatt | tAtac | TTTG | gtaTa | t | |
| 52 | N | aatt | tctGc | TACA | gCaga | t | tctGc stem mutation with different 4-loops |
| 53 | N | aatt | tctGc | TACC | gCaga | t | |
| 54 | N | aatt | tctGc | TACG | gCaga | t | |
| 55 | N | aatt | tctGc | TACT | gCaga | t | |
| 56 | N | aatt | tctGc | TAGC | gCaga | t | |

Fig. 4E continued

| 57 | N | aatt | tctGc | TATN | gCaga | t | |
|---|---|---|---|---|---|---|---|
| 58 | N | aatt | tctGc | TCTA | gCaga | t | |
| 59 | N | aatt | tctCc | TAAA | gGaga | t | tctCc stem mutation with different 4-loops |
| 60 | N | aatt | tctCc | TAAT | gGaga | t | |
| 61 | N | aatt | tctCc | TACN | gGaga | t | |
| 62 | N | aatt | tctCc | TAGA | gGaga | t | |
| 63 | N | aatt | tctCc | TAGT | gGaga | t | |
| 64 | N | aatt | tctCc | TATN | gGaga | t | |
| 65 | N | aatt | tctCc | TCAT | gGaga | t | |
| 66 | N | aatt | tctCc | TCCA | gGaga | t | |
| 67 | N | aatt | tctCc | TCCT | gGaga | t | |
| 68 | N | aatt | tctCc | TCTN | gGaga | t | |
| 69 | N | aatt | tctCc | TGTT | gGaga | t | |
| 70 | N | aatt | tctCc | TTCA | gGaga | t | |
| 71 | N | aatt | tctCc | TTCT | gGaga | t | |
| 72 | N | aatt | tctCc | TTGT | gGaga | t | |
| 73 | N | aatt | tctCc | TTTT | gGaga | t | |
| 31 | N | aatt | tctac | TNNN | gtaga | t | wild-type stem with different 4-loops |
| 74 | N | aatt | tctac | CNNN | gtaga | t | |

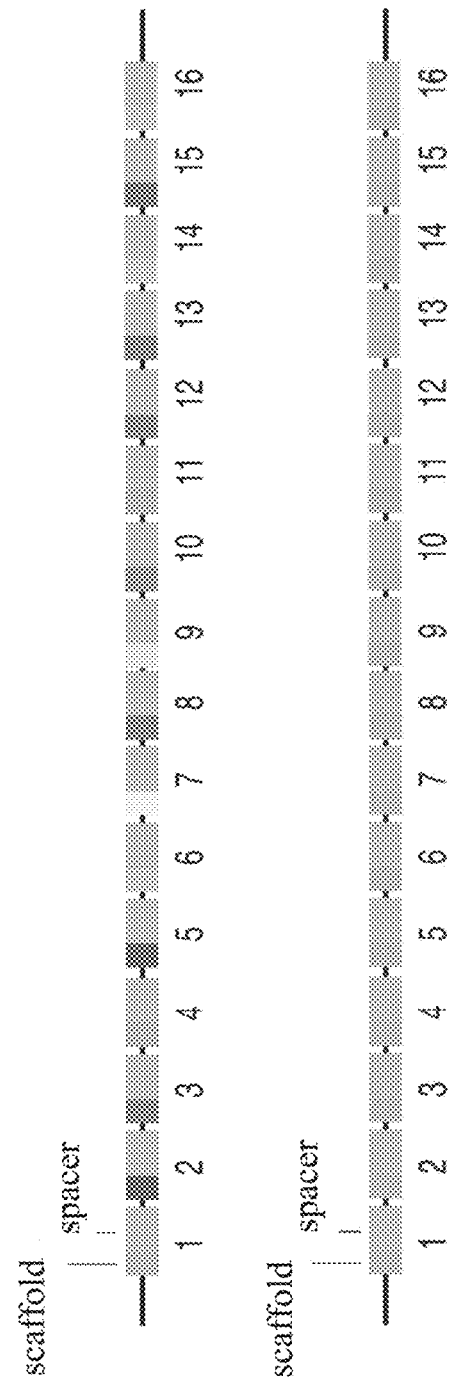

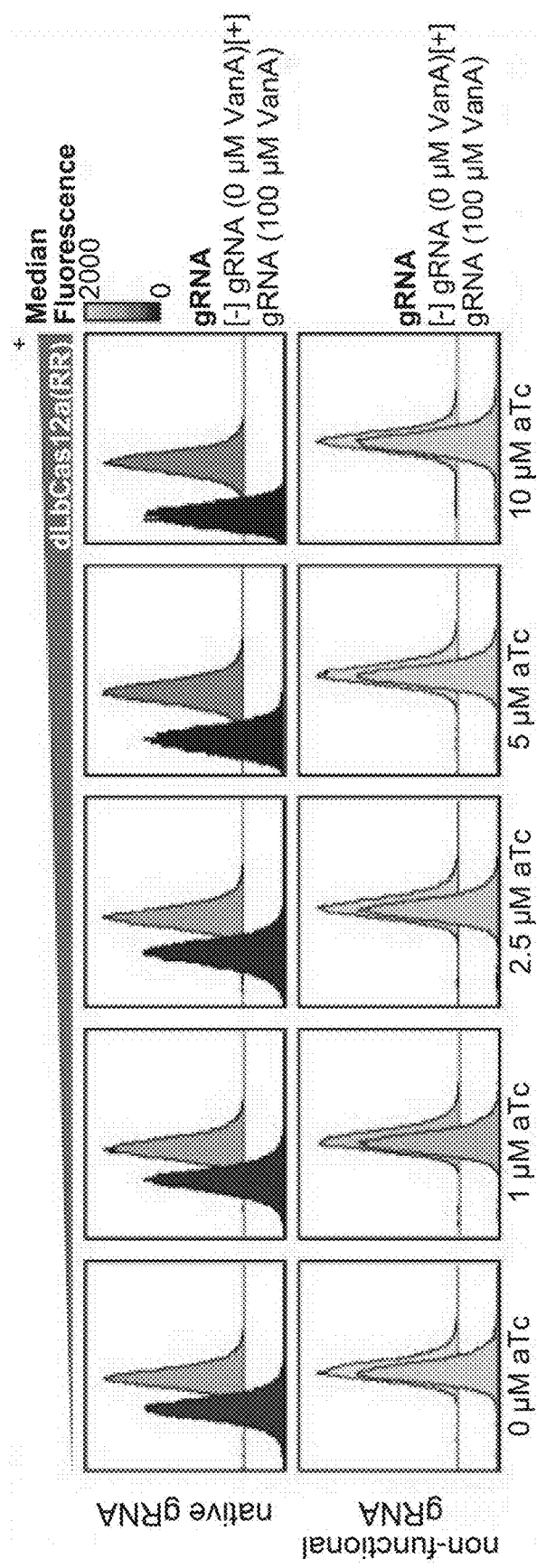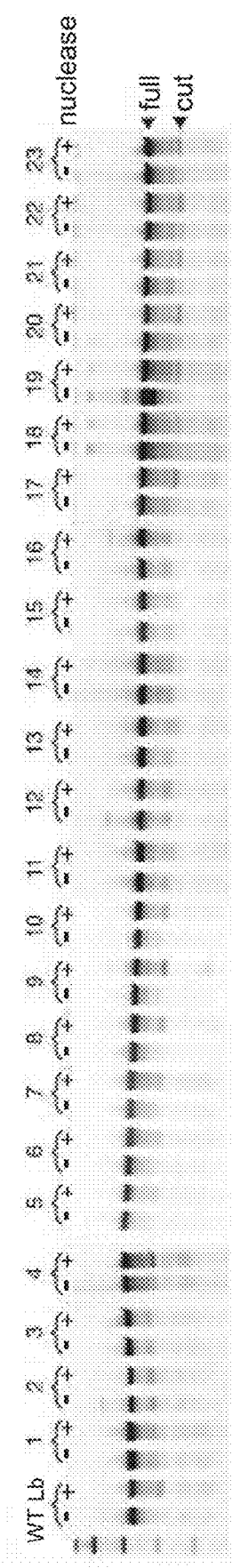
Fig. 8A
Fig. 8B

METHODS OF MULTIPLEXING CRISPR

RELATED APPLICATIONS

This application claims the benefit under 35 U.S.C. § 119(e) of U.S. Provisional application Ser. No. 62/874,719 filed Jul. 16, 2019, the disclosure of which is incorporated by reference herein in its entirety.

SEQUENCE LISTING

The instant application incorporates by reference the Sequence Listing in the ASCII text file entitled "MIT-033US (02) sequence listing_ST25.txt", which was created on Aug. 13, 2020, the size of which file is 670,207 bytes.

FIELD OF THE INVENTION

The invention relates, in part, to methods of designing and constructing gene drive systems and their inclusion and use in cell lines and organisms.

BACKGROUND OF THE INVENTION

The discovery of CRISPR RNA-guided endonucleases have catalyzed huge technological advancements in the field of synthetic biology, such as providing methods of gene editing. These systems have two components: a CRISPR-associated (Cas) protein and a guide RNA consisting of a conserved "scaffold" sequence recognized by the protein and a variable "spacer" complementary to the DNA target of interest. CRISPR-based gene drives can be greatly improved by targeting many sites simultaneously using arrays of guides with different spacers; but previously available arrays have introduced significant stretches of homologous repeats that can affect the generational stability of the drive system

SUMMARY OF THE INVENTION

According to an aspect of the invention, a function-screening system for identifying one or a plurality of guide RNA (gRNA) scaffold molecules is provided, the system including: (a) a Cas protein capable of binding a promoter sequence that is capable of driving expression of a reporter protein; (b) a nucleic acid molecule including the promoter sequence and the sequence encoding the reporter protein; and (c) one or a plurality of nucleic acid molecule fragments, wherein the binding of one the nucleic acid molecule fragments to the Cas protein produces a riboprotein complex capable of binding the promoter sequence, wherein the binding of the riboprotein complex to the promoter reduces transcription of the sequence encoding the reporter protein and reduces the expression of the reporter protein; wherein a reduced level of expression of the reporter protein compared to a control level of expression of the reporter protein identifies the nucleic acid molecule fragment in the riboprotein produced in (c) as a gRNA scaffold molecule. In some embodiments, the promoter is a constitutive promoter. In certain embodiments, the reporter protein comprises a fluorescent protein. In some embodiments, the Cas protein is a Cas12a protein. In some embodiments, the Cas protein is one of: AsCas12a (wild type), LbCas12a, LbCas12a(RR), and enAsCas12a. In certain embodiments, the nucleic acid molecule comprising the promoter sequence and the sequence encoding the reporter protein, and the one or a plurality of nucleic acid molecule fragments are components of the system. In some embodiments, the components are in a cell. In some embodiments, the cell is a bacterial cell. In some embodiments, the cell is a eukaryotic cell. In certain embodiments, the Cas protein is expressed in the cell. In some embodiments, the nucleic acid sequence encoding the Cas protein is delivered to the cell in a vector.

According to another aspect of the invention, a method of identifying one or a plurality of guide RNA scaffold molecules is provided, the method including: (a) screening one or a plurality of nucleic acid molecule fragments using the function-screening system of embodiment of any aforementioned aspect of the invention, and (b) determining a level of expression of the reporter protein, wherein a level of expression of the reporter protein that is lower than a control level of expression of the reporter protein identifies one or more of the plurality of nucleic acid molecule fragments as guide RNA scaffold molecules. In certain embodiments, the control level of expression is a level of expression of the reporter protein in the function-screening system in the absence of a guide RNA scaffold molecule. In some embodiments, the method also includes producing a minimally repetitive array comprising one or more of the identified guide RNA (gRNA) scaffold molecules. In some embodiments, the minimally repetitive array of the gRNA scaffold molecules comprises one or more of a unit comprising: one of the identified gRNAs and an independently selected spacer sequence. In certain embodiments, the spacer sequences comprises a sequence that binds an independently selected nucleic acid sequence. In some embodiments, the minimally repetitive nucleic acid molecule array comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the gRNAs of the units are independently selected and the spacer sequences of the units are independently selected.

According to another aspect of the invention, a processing screening system for identifying one or a plurality of functional sequences corresponding to protein-assisted RNA cleavage/processing is provided the system including: (a) an mRNA molecule including an RNA polymerase (RNAP) mRNA sequence and a sequence corresponding to protein-assisted RNA cleavage/processing at the RNAP 3' end; (b) a nucleic acid molecule encoding a reporter protein; and (c) a Cas protein capable of processing a functional sequence corresponding to protein-assisted RNA cleavage/processing at the RNAP3' end; wherein: (i) translation of the RNAP mRNA sequence after Cas protein processing of the sequence corresponding to protein-assisted RNA cleavage/processing produces a functional RNAP capable of driving expression of the reporter protein; and (ii) translation of the RNAP mRNA sequence without Cas protein processing of the sequence corresponding to protein-assisted RNA cleavage/processing molecule produces an RNAP protein that comprises a C-terminal extension sequence and is not capable of driving expression of the reporter protein; wherein an increased level of expression of the reporter protein compared to a control level of expression of the reporter protein identifies the processed sequence corresponding to protein-assisted RNA cleavage/processing as functional. In some embodiments, the reporter protein comprises a fluorescent protein. In certain embodiments, the Cas protein is a Cas12a protein. In some embodiments, the Cas protein is AsCas12a (wild type), LbCas12a, LbCas12a(RR), and enAsCas12a. In some embodiments, a higher level of expression of the reporter protein produced in the system compared to a control level of expression of the reporter protein indicates processing of the sequence corresponding to protein-assisted RNA cleavage/processing by the Cas protein and identifies the processed sequence as a functional sequence corresponding to protein-assisted RNA cleavage/processing. In some embodiments, the mRNA molecule comprising the RNA polymerase (RNAP) mRNA sequence and sequence corresponding to protein-assisted RNA cleavage/processing molecule at the RNAP 3' end, the nucleic acid molecule encoding the reporter protein, and the Cas protein are components of the system. In certain embodiments, the components are in a cell. In some embodiments, the cell is a bacterial cell. In certain embodiments, the cell is a eukaryotic cell. In some embodiments, the Cas protein is expressed in the cell. In some embodiments, the nucleic acid sequence encoding the Cas protein is delivered to the cell in a vector. In some embodiments, the sequence corresponding to protein-assisted RNA cleavage/processing is a guide RNA (gRNA) scaffold molecule. In certain embodiments, an increased level of expression of the reporter protein compared to a control level of expression of the reporter protein identifies the gRNA scaffold molecule as a functional gRNA scaffold molecule.

According to another aspect of the invention, a method of identifying one or a plurality of functional sequence corresponding to protein-assisted RNA cleavage/processing molecules is provided, the method including: (a) processing one or a plurality of sequence corresponding to protein-assisted RNA cleavage/processing molecules using a processing screening system of any embodiment of any aforementioned aspect of the invention, and (b) determining a level of expression of the reporter protein, wherein a determined level of expression that is higher than a control level of expression of the reporter protein identifies the one or more of the plurality of sequence corresponding to protein-assisted RNA cleavage/processing molecules as functional sequence corresponding to protein-assisted RNA cleavage/processing molecules. In some embodiments, the control level of expression is a level of expression of the reporter protein in the processing screening system in the absence of a functional sequence corresponding to protein-assisted RNA cleavage/processing molecule. In some embodiments, the method also includes including the identified functional sequence corresponding to protein-assisted RNA cleavage/processing in a minimally repetitive array comprising functional sequences corresponding to protein-assisted RNA cleavage/processing molecules. In certain embodiments, the minimally repetitive array of functional sequence corresponding to protein-assisted RNA cleavage/processing molecules comprises one or more of a unit comprising: one of the identified functional sequence corresponding to protein-assisted RNA cleavage/processing molecule and an independently selected spacer sequence. In some embodiments, the spacer sequences comprises a sequence that binds an independently selected nucleic acid sequence. In some embodiments, the minimally repetitive nucleic acid molecule array comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the sequences corresponding to protein-assisted RNA cleavage/processing molecules of the units are independently selected and the spacer sequences of the units are independently selected. In certain embodiments, the sequence corresponding to protein-assisted RNA cleavage/processing is a guide RNA (gRNA) scaffold molecule. In some embodiments, an increased level of expression of the reporter protein compared to a control level of expression of the reporter protein identifies the gRNA scaffold molecule as a functional gRNA scaffold molecule. In some embodiments, the method also includes including the identified functional gRNA scaffold molecule in a minimally repetitive array comprising functional gRNA scaffold sequences. In certain embodiments, the minimally repetitive array of functional gRNA scaffold molecules comprises one or more of a unit comprising: one of the identified functional gRNA scaffold molecules and an independently selected spacer sequence. In some embodiments, the spacer sequences comprises a sequence that binds an independently selected nucleic acid sequence. In certain embodiments, the minimally repetitive nucleic acid molecule array includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the sequences corresponding to gRNA scaffold molecules of the units are independently selected and the spacer sequences of the units are independently selected.

According to yet another aspect of the invention, a method of identifying a plurality of variant nucleic acid molecules, wherein each of the variant nucleic acid molecules is capable of being processed by an RNA-processing protein to produce a plurality of functional nucleic acid molecule fragments capable of targeting one or more RNA-guided nucleic acid binding proteins to bind an independently preselected nucleic acid sequence, is provided. In some embodiments, each of the independently preselected nucleic acid sequences is positioned in a target genetic element. In some embodiments, the RNA-processing protein is the same protein as the RNA-guided nucleic acid binding protein. In certain embodiments, the binding of the one or more RNA-guided nucleic acid binding proteins to the independently preselected nucleic acid sequence detectably modifies expression of a reporter gene. In some embodiments, the RNA-processing protein processes the variant nucleic acid molecules in a cell. In some embodiments, the cell is a bacterial cell. In certain embodiments, the cell is a eukaryotic cell. In some embodiments, the RNA processing modifies expression of a reporter gene. In some embodiments, the RNA-guided nucleic acid binding protein is a nuclease capable of cutting the independently preselected nucleic acid sequences. In some embodiments, the RNA-guided nucleic acid binding protein is a Cas protein. In certain embodiments, the RNA-guided nucleic acid binding protein is a Cas12a protein. In some embodiments, the Cas protein is a AsCas12a (wild type), LbCas12a, LbCas12a (RR), or enAsCas12a protein. In some embodiments, the plurality of variant nucleic acid molecules includes one or more guide RNA (gRNA) molecules. In certain embodiments, the plurality of variant nucleic acid molecules includes one or more one functional gRNA molecules. In some embodiments, the independently preselected nucleic acid sequence includes all or a portion of a promoter sequence. In some embodiments, the promoter modulates transcription of the sequence encoding the reporter protein. In certain embodiments, the promoter is a constitutive promoter. In some embodiments, the reporter protein includes a fluorescent protein.

According to yet another aspect of the invention, a method of generating a minimally repetitive array of variant nucleic acid molecule fragments is provided, the method including: (a) identifying a plurality of variant nucleic acid molecules, wherein each of the variant nucleic acid molecules is capable of being processed by an RNA-processing protein to produce a plurality of functional nucleic acid molecule fragments each capable of targeting one or more RNA-guided nucleic acid binding proteins to bind an independently preselected nucleic acid sequence; (b) generating the plurality of functional nucleic acid molecule fragments by processing the plurality of variant nucleic acid molecules with the RNA-processing protein; and (c) combining the generated plurality of functional nucleic acid molecule fragments to generate a minimally repetitive array capable of directing the one or more RNA-guided nucleic acid binding proteins to bind a plurality of the independently preselected nucleic acid sequences. In some embodiments, each of the independently preselected nucleic acid sequences is positioned in a target genetic element. In certain embodiments, the RNA-guided nucleic acid binding protein is a nuclease capable of cutting the independently preselected nucleic acid sequences. In some embodiments, the RNA-processing protein is the same protein as the RNA-guided nucleic acid binding protein. In some embodiments, the RNA-guided nucleic acid binding protein is a Cas protein. In certain embodiments, the RNA-guided nucleic acid binding protein is a Cas12a protein. In some embodiments, the Cas protein is: AsCas12a (wild type), LbCas12a, LbCas12a(RR), or enAsCas12a protein. In certain embodiments, the binding of the one or more RNA-guided nucleic acid binding proteins to the independently preselected nucleic acid sequence detectably modifies expression of a reporter gene. In some embodiments, the RNA-processing protein processes the variant nucleic acid molecules in a cell. In some embodiments, the cell is a bacterial cell. In certain embodiments, the cell is a eukaryotic cell. In some embodiments, the RNA processing modifies expression of a reporter gene. In some embodiments, the plurality of variant nucleic acid molecule fragments includes guide RNA (gRNA) molecules. In some embodiments, the plurality of variant nucleic acid molecule fragments includes functional gRNA molecules. In certain embodiments, the minimally repetitive nucleic acid molecule array comprises one or more of a unit comprising: gRNA and a spacer sequence. In some embodiments, the spacer sequences include a sequence that binds one of the independently preselected nucleic acid sequences. In some embodiments, the minimally repetitive nucleic acid molecule array comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the gRNAs of the units are independently selected and the spacer sequences of the units are independently selected.

According to another aspect of the invention, a multiplex nucleic acid targeting system in provided, the system including one or more minimally repetitive nucleic acid molecule arrays capable of directing one or more RNA-guided nucleic acid binding proteins to bind a plurality of independently preselected nucleic acid sequences, wherein the minimally repetitive nucleic acid molecule array includes a plurality of variant nucleic acid molecules, wherein each of the variant nucleic acid molecules is capable of being processed by an RNA-processing protein to produce a plurality of nucleic acid molecule fragments each capable of directing one or more RNA-guided nucleic acid binding proteins to bind an independently preselected target nucleic acid sequence. In certain embodiments, the plurality of variant nucleic acid molecules is identified using an embodiment of any of the aforementioned methods and/or systems. In some embodiments, each of the independently preselected nucleic acid sequences is positioned in a target genetic element. In some embodiments, the one or more RNA-guided nucleic acid binding proteins include one or more RNA-guided nucleases. In certain embodiments, the system includes a minimally repetitive array of sequence variants capable of directing one or more of the RNA-guided nucleases to cut one or more sequences present within one or more target genetic elements. In some embodiments, the minimally repetitive nucleic acid molecule array includes one or more of a unit comprising: a gRNA scaffold molecule and a spacer sequence. In certain embodiments, the spacer sequence includes a sequence that binds one of the independently preselected nucleic acid sequences. In some embodiments, the minimally repetitive nucleic acid molecule array includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the gRNAs of the units are independently selected and the spacer sequences of the units are independently selected.

According to another aspect of the invention, a method of reliably cutting one or more target genetic elements is provided, the method including constructing a minimally repetitive array of sequence variants capable of directing one or more RNA-guided nucleases to cut the one or more sequences present within each genetic element, wherein a means of constructing comprises one or more of an embodiment of any aforementioned methods of systems. In some embodiments, the one or more target genetic elements correspond to one or more genes of a target organism. In some embodiments, the minimally repetitive array is encoded within the genome of an organism. In certain embodiments, the cutting of the one or more genes at more than one sequence per gene reduces the likelihood that a mutant gene in the population is not cut. In some embodiments, the cutting of the one or more genes at the one or more target sequences increases a frequency of an occurrence of an engineered construct within a population of the relevant organism. In some embodiments, the one or more target sequences correspond to one or more viruses. In certain embodiments, cutting the one or more target sequences corresponding to one or more viruses confers resistance to the one or more viruses. In some embodiments, integrating the array into the genome of the target organism confers resistance in the target organism to the one or more viruses. In some embodiments, targeting each targeted virus at more than one sequence reduces the likelihood that a mutant virus is not cut.

According to yet another aspect of the invention, a composition that includes one or more nucleic acid molecules comprising a nucleic acid molecule comprising a sequence set forth as one of SEQ NOs: 31-3280 is provided. In certain embodiments, the composition also includes a vector.

According to yet another aspect of the invention, a composition that includes one or more nucleic acid molecules having a sequence set forth as one of SEQ NOs: 31-3280 is provided. In some embodiments, the composition also includes a vector.

According to another aspect of the invention, a cell comprising an embodiment of any of the aforementioned systems is provided.

According to another aspect of the invention, a cell comprising an embodiment of any of the aforementioned minimally repetitive gRNA arrays is provided. In some embodiments one of more gRNAs in the repetitive arrays is selected from SEQ ID NO: 31-3280.

According to another aspect of the invention, a cell comprising an embodiment of any of the aforementioned gRNA scaffolds is provided.

According to another aspect of the invention, a cell comprising one or more nucleic acid molecules comprising a sequence set forth as SEQ NOs: 31-3280 is provided.

According to yet another aspect of the invention, a composition that includes one or more nucleic acid molecules having a sequence set forth in one of Tables 1-13 is provided. In some embodiments, the composition also includes a vector.

According to another aspect of the invention, a cell comprising an embodiment of any of the aforementioned systems is provided.

According to another aspect of the invention, a cell comprising an embodiment of any of the aforementioned minimally repetitive gRNA arrays is provided.

According to another aspect of the invention, a cell comprising an embodiment of any of the aforementioned gRNA scaffolds is provided.

According to another aspect of the invention, a cell comprising one or more nucleic acid molecules comprising a sequence set forth in one of Tables 1-13 is provided.

BRIEF DESCRIPTION OF THE DRAWINGS

FIG. 1A illustrates that this system constitutively expresses RFP mRNA in the absence of dLbCas12a and a functional gRNA scaffold. FIG. 1B-C illustrate that fluorescence suppression requires both dLbCas12a and a functional gRNA scaffold (FIG. 1C). Fluorescence is not suppressed in the absence of a gRNA scaffold that can bind both the dLbCas12a nuclease and the DNA target sequence (FIG. 1B). FIG. 1D illustrates a screening workflow for a CRISPR-based DNA binding gene circuit system. A nuclease dead enzyme may be identified herein by "d" preceding the enzyme name, for example, a nuclease-dead Cas12a may also be written: "dCas12a".

FIG. 2A-C shows a schematic diagram of an inducible CRISPR-based DNA binding circuit (FIG. 2A) and graphs and a table of data from DNA binding circuit experiments (FIG. 2B-C). The FIG. 2A schematic illustrates that gRNA scaffold variants and a nuclease-dead Cas12a are produced from inducible plasmids and form a riboprotein complex to suppress a constitutive promoter for RFP. The graph in FIG. 2B shows results from induced circuits expressing dCas12a and gRNA. Induction of a functional guide RNA (gRNA) and dCas12a results in a substantial decrease in RFP signal. The graphs and table in FIG. 2C show results from two repetitions of screening a variant scaffold library.

FIG. 4A-E shows a schematic diagram, a photomicrograph, and tables presenting results for a DNA binding screen with dLbCas12a (RR variant). FIG. 4A (left panel) shows a schematic of a wild-type LbCas12a gRNA scaffold (SEQ ID NO: 1). It consists of 21 nucleotides (nt), with a pre-stem, a characteristic hairpin with a 5-basepair (bp) stem and a 5-nt loop, and a spacer sequence. FIG. 4A (right panel) shows a photomicrograph of results from in vitro DNA cleavage assays confirming that DNA binding screens enrich for highly active scaffolds. In FIG. 4B-D, cells in the tables shown with black borders (black boxes) indicate the wild-type sequence. FIG. 4B shows enrichment scores for single-site degenerate gRNA scaffolds screened (from top to bottom of the left-hand column, SEQ ID NOs: 2-22). FIG. 4C shows enrichment scores for screened variants with pairwise degeneracy in the gRNA scaffold stem region (top set and lower set include the same sequences, which are from top to bottom of the left-hand column in each set: SEQ ID NOs: 23-27). The FIG. 4D shows enrichments scores for fully degenerate 4, 5, and 6-nt loops paired with 3 mutant stems proven to be active for DNA cleavage in vitro (all four sets include the same sequences, with are from top to bottom of the left-hand column of each set: SEQ ID NOs: 28-31). For all four sets shown, top row Stem 1=UAUAC - - - AUAUG; second row down Stem 2=UCUGC - - - GCAGA; third row down: Stem 3=UCUCC - - - GGAGA. Fourth row down: Wildtype (WT)=UCUAC - - - GUAGA. The FIG. 4E sequence table lists SEQ ID NOs: 31-74, the DNA sequences encoding the functional gRNA sequences shown in FIG. 4B-D. For SEQ ID NOs: 2-74, N=A, C, G, or T.

FIG. 5C provides a graph showing results of induced circuits expressing T7-tgRNA+RNAse-active vs. inactive Cas12a. In gRNA processing circuit experiments, the result was a distinct increase in fluorescence when gRNA processing occurred. GFP is green fluorescent protein; Pol is polymerase.

FIG. 7A-B shows graphs of the pairing probabilities and secondary structure of LbCas12a guide sequence with the repeat sequence TAATTTCTACTAAGTGTAGAT [SEQ ID NO: 75] and spacer sequence TATCAGTGATAGAGAACGTATGT [SEQ ID NO: 76] (FIG. 7A) and presents a schematic diagram of a commercially synthesizable large guide array (FIG. 7B). The calculations shown in FIG. 7A were performed using Nupack software (Nadeh et al, 2011). The schematic shown in FIG. 7B illustrates that large guide arrays for synthesis comprising highly active Cas12a scaffolds (enriched far above WT in a DNA binding screen) with diverse sequences (upper array, diversity shown by varying colors/shades) can be commercially synthesized, whereas the same array using only WT scaffolds (lower array, lack of diversity shown by single color/shade) cannot be commercially synthesized.

FIG. 8A-D presents graphs and photomicrographs from bacterial library screens for DNA binding, RNA processing, and in vitro cleavage. FIG. 8A shows histograms from fluorescence cytometry analysis of cells containing a dLbCas12a(RR) DNA binding circuit with either a gRNA native scaffold (top row) or a gRNA with a scaffold region consisting of a random 21-nucleotide sequence that was predicted to be non-functional (bottom row). FIG. 8B shows photomicrographs of in vitro RNA processing gels in which an RNA transcript containing a wild-type or mutant scaffold sequence was incubated with (+) or without (−) LbCas12a protein. (Images were collated from several gels, marker in first lane not exact replica of marker for each gel used). FIG. 8C shows histograms from fluorescence cytometry analysis of wild-type *E. coli* cells containing an RNA processing circuit with either an RNase-active or RNase-inactive dLbCas12a(RR). Cells were induced with aTc and VanA. FIG. 8D shows histograms from fluorescence cytometry analysis of ArfA-overexpressing *E. coli* cells containing an RNA processing circuit with either a RNase-active or RNase-inactive dLbCas12a(RR). Cells were induced with aTc and VanA.

FIG. 9A shows a schematic diagram of a circuit design for a mammalian scaffold-spacer pairing assay. FIG. 9B shows photomicrographs of fluorescent microscopy analysis of HEK293T cells transfected with dLbCas12a-VPR and a reporter-gRNA construct. The positive control utilized a single wild-type scaffold and a TetO VPR reporter construct containing 7 target binding sites. The negative control utilized a single random 21-nucleotide sequence and a TetO VPR reporter construct containing 7 target binding sites. Non-control cells were transfected with the reporter-gRNA construct containing different spacings and number of binding sites.

FIG. 11A shows a schematic of a "broken" array circuit design. FIG. 11B shows an example histogram of fluorescent cytometry analysis of a broken array containing either a wild-type scaffold flanking the TetO spacer or a broken (non-RNA-processing) scaffold variant. FIG. 11C shows photomicrographs of fluorescent microscopy analysis of HEK293T cells co-transfected with a TetO VPR Reporter construct, a broken array construct containing the wild-type scaffold flanking the TetO spacer, and either an RNase-active or RNase-inactive dLbCas12a-VPR.

DETAILED DESCRIPTION

Figure 1A:
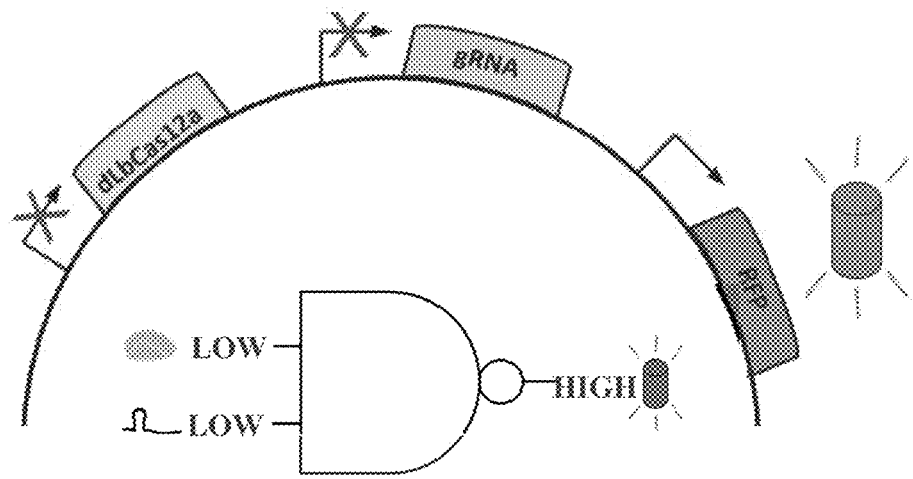
FIG. 1A-D shows schematic diagrams of a CRISPR-based DNA binding gene circuit system for functional screening of gRNA scaffold efficiency and efficacy based on a measurable output. In this system, functional gRNA scaffolds complex with dLbCas12a, a nuclease-dead Cas12a, creating a riboprotein complex that binds a constitutive promoter driving a red fluorescent protein (RFP). Successful binding of the riboprotein complex represses RFP transcription, thereby lowering the fluorescent signal that is the measurable output of the circuit. Successful binding of DNA targets is used as a proxy for target cleavage.

Genetic circuits have now been prepared and used to perform functional screens of guide RNA (gRNA) scaffold molecules, thus permitting effective and efficient multiplexing of nucleic acid targeting methods and systems. Methods and systems have now been identified that permit selection of divergent yet functional scaffold sequences for gRNAs that minimize secondary structure with the targeting sequence, thereby maximizing the resulting activity of the gRNA scaffold molecules. In some embodiments, systems and methods of the invention include identifying functional sequences corresponding to protein-assisted RNA cleavage/processing. Methods and systems of the invention can also be used for efficient synthesis of pre-CRISPR RNA (crRNA) arrays of guide RNAs capable of multiplexed nucleic acid targeting through the identification and use of divergent yet functional scaffold guide RNA sequences as detailed herein. Additional aspects of the invention include methods and systems for selecting a divergent yet functional scaffold sequence for a guide RNA that minimizes secondary structure with the targeting sequence, thereby maximizing the resulting activity. Another aspect of the invention includes methods and systems that can be used for efficient synthesis of pre-crRNA arrays of guide RNAs capable of multiplexed targeting through the identification and use of divergent yet functional scaffold guide RNA sequences as detailed above. Another aspect of the invention includes guide RNA (gRNA) scaffold molecules. gRNA scaffold molecules are capable of both RNA-processing and Cas12a-directed DNA-binding (e.g. enabling multiplexing) for each of the four enzymes Aspects of the invention provide the ability to readily synthesize functional arrays of many guide RNAs permitting the targeting of CRISPR systems to any different sequences. The ability to synthesize and use such arrays is also broadly useful in other areas of biotechnology that benefit from multiplexing, including but not limited to nucleic acid editing, gene regulation, labeling, and cellular defense.

Screening Systems and Methods

Methods and systems of the invention, such as certain embodiments of function-screening systems of the invention and processing screening systems of the invention permit identification of diverse guide RNA scaffolds capable of constructing minimally repetitive arrays that can be used to target many sequences in the same cell. A number of features of function-screening and processing-screening methods and systems of the invention substantially improve the ability to identify and use gRNA scaffolds. One feature is the ability to use the systems and methods to identify diverse gRNA scaffolds that can be included in minimally repetitive arrays. Such arrays are readily synthesized and, when encoded into an organism, are more evolutionarily stable than previously known gRNA scaffolds and arrays. Another feature is that the systems and methods of the invention can be used in a manner that permits preparing diverse gRNA scaffolds and arrays such that a target sequence can be matched with a gRNA scaffold, thus permitting generation and use of diverse gRNA scaffold arrays that minimize secondary structure and therefor maximize activity of gRNA arrays of the invention. Certain aspects of the invention included systems that can be used to identify components such as gRNA scaffolds and gRNA scaffold arrays that can be used in nucleic acid targeting systems and methods.

Function-Screening

Figure 1B:
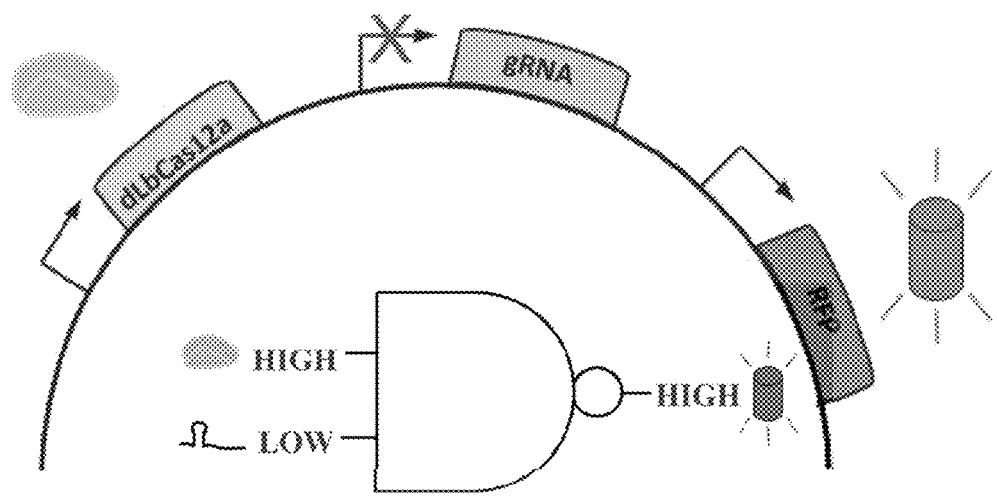
Figure 1C:
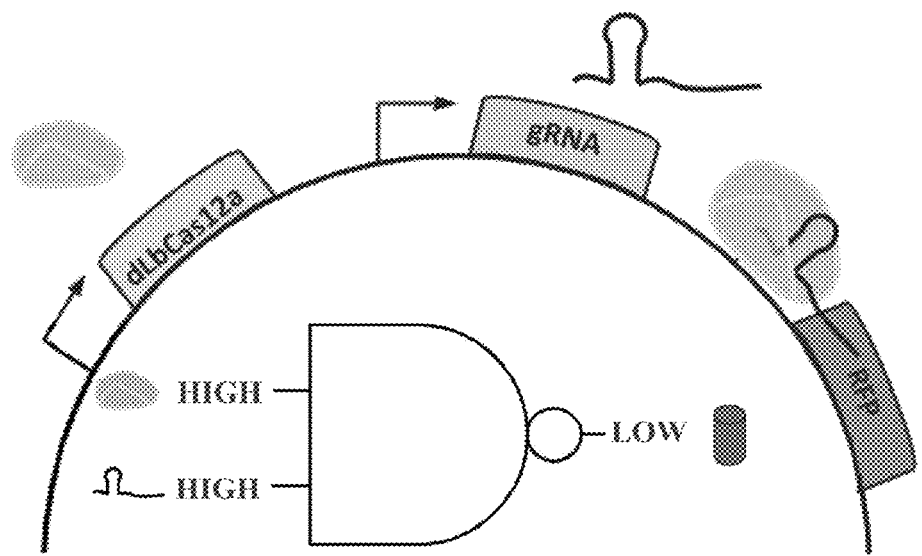
Figure 1D:
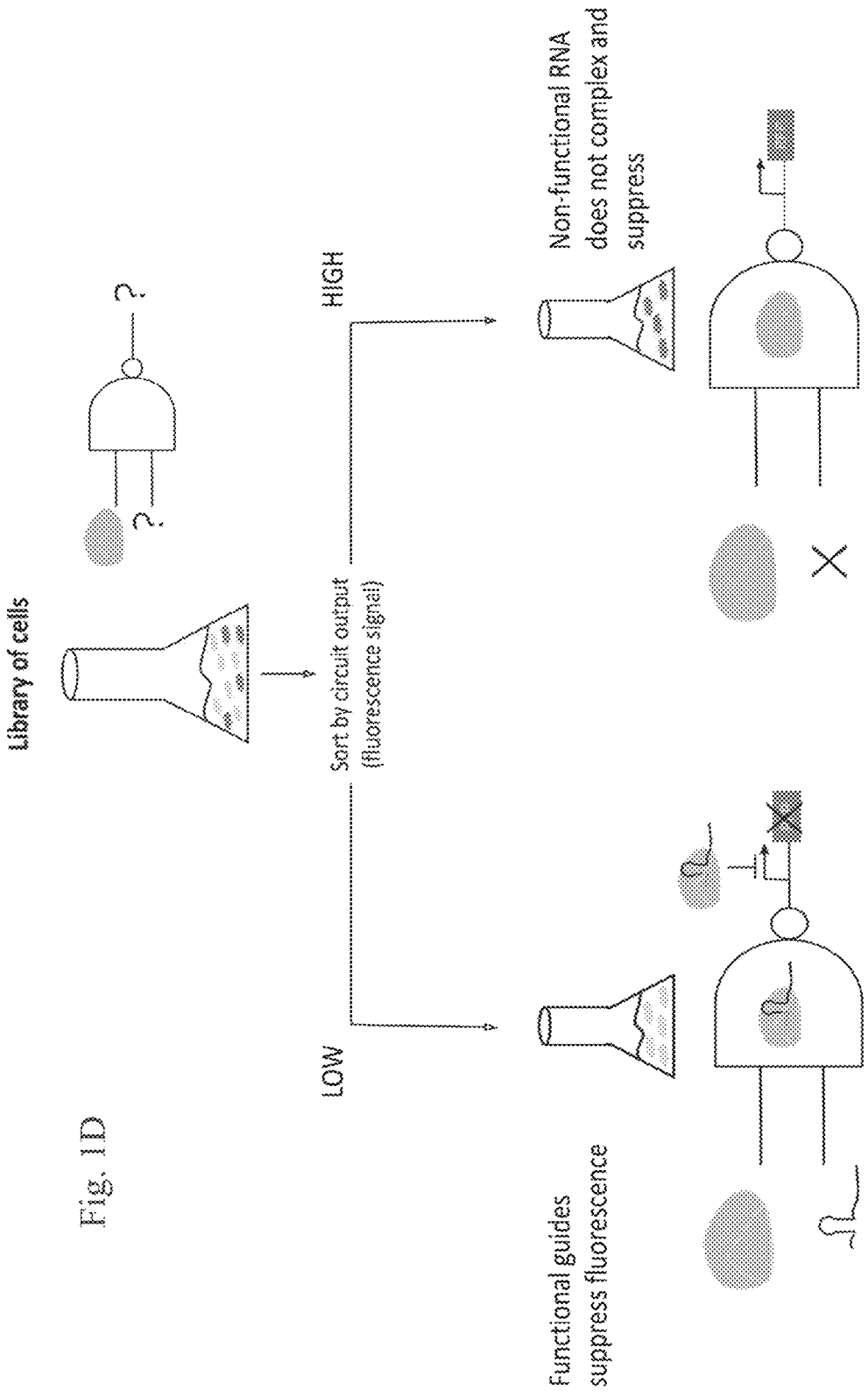

One system of the invention that can used in methods to identify and screen for gRNA scaffold molecules is referred to herein as a "function-screening system" and/or a "DNA binding circuit system". A schematic of an embodiment of a function-screening system is provided in FIG. 1A-C. A function-screening system of the invention can be used to identify one or a plurality of guide RNA (gRNA) scaffold molecules and is a reporter-based screening system. An embodiment of the system includes a binding protein, a non-limiting example of which is a Cas protein, and the binding protein is capable of binding a promoter sequence, which is capable of driving expression of a reporter protein. This embodiment of the system also includes one or a plurality of nucleic acid molecule fragments and the binding of one of the fragments with one of the binding proteins results in a riboprotein complex, which is capable of binding the promoter sequence. When a riboprotein complex binds the promoter it suppresses transcription of the sequence encoding the reporter protein, thereby reducing expression of the reporter protein and the reporter protein's detectable signal. Thus, in a function screening system of the invention, a reduction in the detectable signal of the reporter protein indicates the binding of one or more of the nucleic acid molecule fragments to one or more of the reporter protein, which identifies the nucleic acid molecule fragment as a guide RNA molecule. The system can be in a cell and may also include DNA molecule comprising the promoter sequence and the sequence encoding the reporter protein. In a function-screening system of the invention, the level of expression in a test cell can be compared to a control level of expression and the reduced level in the test cell versus the control identifies the nucleic acid molecule fragment in the riboprotein produced in as a gRNA scaffold molecule. A non-limiting example of a control level is a level obtained in the system that lacks formation of a riboprotein complex, therefore lacking the suppression of expression of the reporter protein. Some embodiments of function-screening systems and methods of the invention can be performed in eukaryotic cells, for example systems and methods of the invention may comprise transcriptional activation using a CRISPR-based transcriptional activator targeted to a reporter gene with a minimal promoter sequence.

Processing-Screening

Figure 2C:
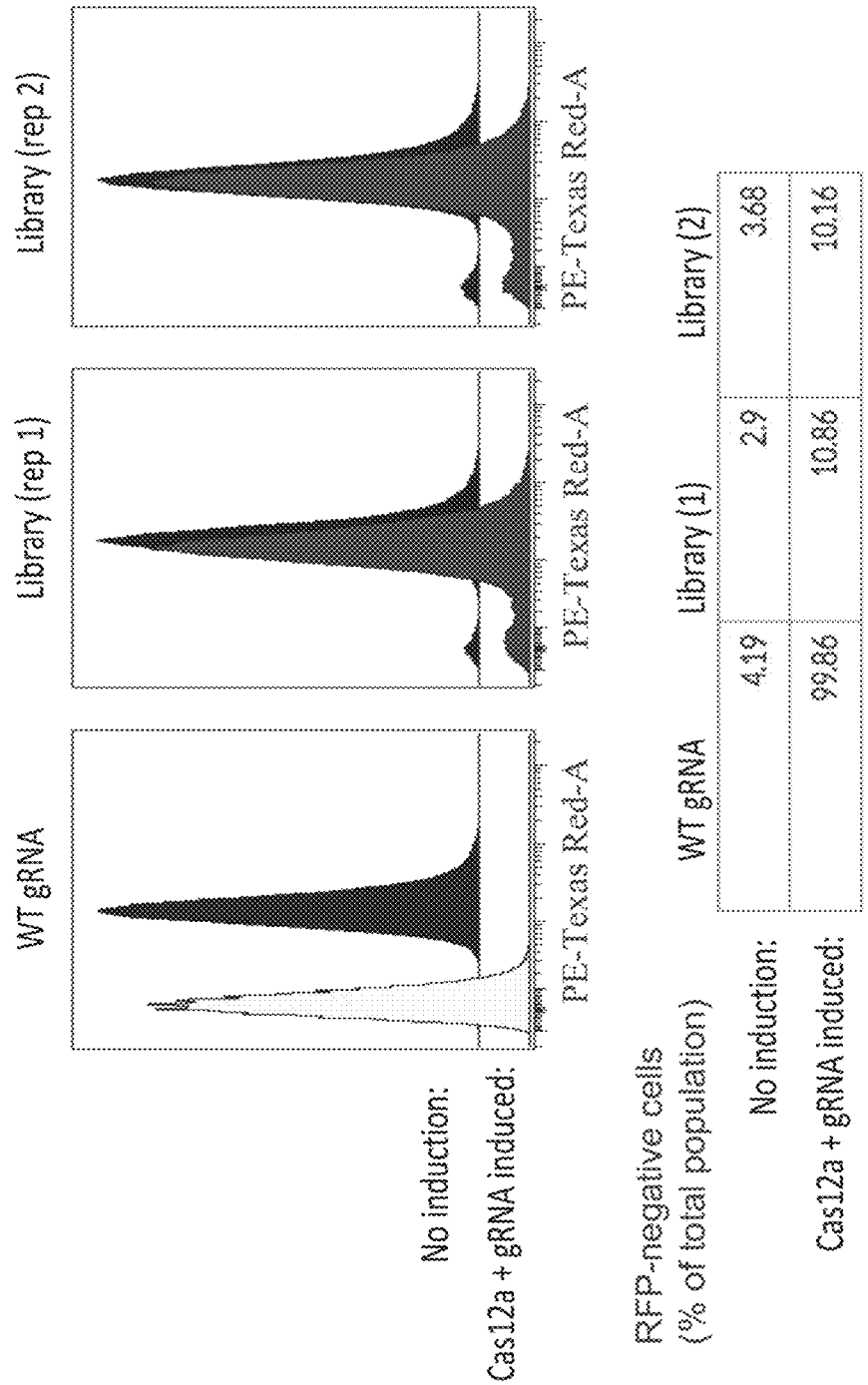

Another system that can be used in methods to identify and screen for gRNA scaffold molecules is referred to herein as a "processing-screening system" and a "gRNA processing circuit" system. A schematic diagram illustrating an embodiment of a processing-screening system of the invention is provided in FIG. 2A-C. A processing-screening system of the invention can be used to identify one or a plurality of functional sequences corresponding to protein-assisted RNA cleavage/processing and is a reporter-based screening system. An embodiment of the system includes an mRNA molecule comprising an RNA polymerase (RNAP) mRNA sequence and a sequence corresponding to protein-assisted RNA cleavage/processing at the RNAP 3' end. The system also includes a nucleic acid molecule encoding a reporter protein; and the system also includes a protein, a non-limiting example of which is a Cas protein, and the protein is capable of processing a functional sequence corresponding to protein-assisted RNA cleavage/processing at the RNAP3' end. If the protein is able to process the functional sequence, translation of the RNAP mRNA sequence produces a functional RNAP that is capable of driving expression of the reporter protein; but if the protein is unable to process the functional sequence, translation of the RNAP mRNA sequence produces an RNAP protein that comprises a C-terminal extension sequence and this is incapable of driving expression of the reporter protein. In this situation, the reporter protein is produced only if the processing is successful, thus, only if the processing is successful is there an increased level of expression of the reporter protein versus a control level of expression of the reporter protein, and the increased expression identifies the processed sequence corresponding to protein-assisted RNA cleavage/processing as functional. A non-limiting example of a control level is a level obtained in the system in which processing does not occur, therefore lacking the expression of a functional reporter protein. In some embodiments of the invention, a sequence corresponding to protein-assisted RNA cleavage/processing is a gRNA scaffold sequence. In some embodiments of the system and/or method of the invention, the system is located in a cell. Some embodiments of processing-screening systems and methods of the invention can be performed in eukaryotic cells, for example though not intended to be limiting: systems and methods of the invention may comprise mRNA cutting to separate 5' cap or polyA tail and reduce translation of a reporter protein.

General Screening and Multiplex Information

As described herein, methods and systems of the invention can be used to identify gRNA scaffold molecules, and to identify sequences such as but not limited to: functional sequences corresponding to protein-assisted RNA cleavage/processing and guide RNA (gRNA) molecules. Certain aspects of the invention include one or more of design, preparation, and use of gRNA molecules that are part of minimally repetitive arrays, which can be used in multiplex nucleic acid targeting methods and systems. As used herein the terms: "nucleic acid targeting methods" and "nucleic acid target systems" include methods and systems that may be included in systems such as, but not limited to: CRISPR methods and systems. Some aspects of the invention include one or more of design, preparation, and use of minimally repetitive arrays in nucleic acid targeting methods and systems. Certain aspects of the invention include one or a plurality of functional sequences that correspond to protein-assisted RNA cleavage/processing, which can be used in multiplex nucleic acid target methods and systems. As used herein the term: "plurality" means more than one. In some embodiments of the invention, plurality means: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 or more.

Certain embodiments of systems and methods of the invention can be used to identify sequences capable of one or both of directing nucleic acid binding and directing nucleic acid processing. Thus, some identified gRNA sequences are capable of directing nucleic acid binding but not processing; other identified gRNA sequences are capable of processing but not directing nucleic acid binding; and certain identified gRNA sequence are capable of directing nucleic acid binding and processing. In a non-limiting example, one or a plurality of diverse gRNA scaffold molecules are identified using methods of the invention, and the identified molecules are also gRNA scaffolds for processing. Using methods and systems of the invention, diverse sequences may be identified that don't do both, for example, methods of the invention can be used to identify variant Cas9 sgRNA scaffolds for direction and methods of the invention can be used to identify divergent Csy4 scaffolds for processing. Some embodiments of the invention may include combining the two identified scaffolds to generate stable gRNA scaffold arrays with divergent sequences capable of massive multiplexing.

Certain aspects of the invention include functional screens and screening methods with which gRNA scaffolds can be identified and tested. Some functional screens of the invention may comprise prokaryotic transcriptional logic gates and other circuit designs to produce reporter outputs corresponding to DNA target binding and gRNA processing, a crucial function for efficient multiplexing. Methods of the invention may be used in conjunction with FACS sorting for screening large libraries of gRNA permutations for selection of desired characteristics. Certain embodiments of methods and/or systems of the invention may also include subsequent deep-sequencing methods, which reveal enrichment for novel functional scaffold sequences. These orthogonal gRNA scaffolds of the invention, which have limited homology to the conserved wild-type sequence, can be used to expand the usefulness of nucleic acid targeting methods and systems, a non-limiting examples of which are CRISPR methods, for synthetic biologists as well as others interested in more effective multiplex nucleic acid targeting methods. In addition to providing novel methods for multiplex CRISPR, methods of the invention may be used to assess and determine the sequence space of gRNA scaffolds, which provides insight into mechanisms of guide RNA recognition and processing systems, such as, but not limited to Cas systems.

Arrays

Embodiments of the invention may also include methods and systems for preparing a high efficiency array of nucleic acid molecule, also referred to herein as guide RNAs (gRNAs), that direct RNA-guided DNA binding proteins in nucleic acid targeting methods. Systems such as CRISPR systems may be included in a cell and a component of the system, for example, an enzyme that is part of the CRISPR system may be expressed in a cell, the expressed enzyme may bind with a guide RNA, and the complex (or riboprotein) may act at a preselected target DNA site. Methods and systems of the invention may be used to design and generate highly efficient arrays of gRNAs, which unlike previous gRNA arrays can be designed in a manner that includes minimal repetitive sequence regions. Previous attempts to prepare arrays comprising multiple gRNAs have been limited by the inability to reduce or eliminate inclusion of repetitive sequences, which inhibited DNA synthesis of large arrays that were intended for multiplexing nucleic acid targeting and may render arrays prone to internal deletions common for sequences with repetitive regions. Unlike previous arrays, methods of the invention permit the design and generation of gRNA arrays with minimal if any repetitive sequences, thus permitting inclusion of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more independently selected gRNAs in a minimal repetitive array of the invention.

Minimally repetitive arrays of the invention can be used in multiplex nucleic acid targeting methods and systems, including but not limited to multiplex CRISPR methods and systems. Some embodiments of the invention include methods to design and generate one or more repetitive arrays of gRNAs. Other embodiments of the invention include the use of one or more minimally repetitive gRNA arrays in nucleic acid targeting, for example, nucleic acid targeting in a host (target) cell or organism.

gRNA Array Structure

A general view of a minimally repetitive array of gRNA scaffolds of the invention is provided herein. In certain embodiments of the invention, a minimally repetitive array of gRNA scaffold molecules comprises one or more "units" each comprising: an independently selected gRNA scaffold molecule and an independently selected spacer sequence. Thus, a gRNA scaffold array of the invention comprises one or more units in a linear configuration, for example though not intended to be limiting, the following is a general illustration of a partial gRNA array:

UNIT ONE                 UNIT TWO
- gRNA scaffold 1 -- spacer 1 -- gRNA scaffold 2 -- spacer 2 -

-continued

UNIT THREE
-gRNA scaffold 3 -- spacer 3-

As shown illustrated in the diagram above, "Unit One" comprises gRNA scaffold 1 and spacer 1; "Unit Two" comprises gRNA scaffold 2 and spacer 2; and "Unit Three" comprises gRNA scaffold 3 and spacer 3. Because each gRNA scaffold and each spacer are independently selected, each gRNA scaffold in a gRNA array of the invention may be preselected to be different than every other gRNA in the array, or may be preselected to be the same as one or more of the other gRNA scaffold molecules in the array. Similarly, each spacer sequence in a gRNA array of the invention may preselected to be different than every other spacer sequence in the array of the invention or may be preselected to be the same as one or more of the other spacer sequences in the array. It will be understood that in some embodiments of the invention each spacer sequence comprises a sequence that binds an independently selected nucleic acid sequence. Thus, if each spacer sequence is different than all others in the gRNA array of the invention, each spacer binds a different nucleic acid sequence.

As described herein, methods of the invention to identify diverse gRNAs and screen for function and processing, permit inclusion of one or more gRNA scaffold molecules in an array. Such arrays can be included and used in multiplex nucleic acid targeting systems and methods, including but not limited to CRISPR-based genome editing systems and methods. A gRNA array of the invention may be referred to herein as a minimally repetitive gRNA scaffold array or a minimally repetitive gRNA array. It has now been identified that embodiments of methods and screening systems of the invention can be used to identify functional and diverse gRNA scaffold sequences, and that such sequences can be used to prepare one or more minimally repetitive gRNA arrays that may comprise: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more "units", wherein the gRNA in each unit is independently selected and the spacer sequence in each unit is independently selected.

One feature resulting from the ability to identify and generate diverse gRNA scaffolds as set forth herein, is the ability to prepare large and effective gRNA arrays. Methods and systems of the invention can be used to identify diverse gRNA scaffolds capable of use in minimally repetitive arrays that can be synthesized to include more units than had been possible using previous gRNA identification methods. Activity and functionality of identified gRNA sequences can be assessed using methods and systems of the invention, or other suitable art-known methods. Screening methods and systems of the invention permit identification of gRNAs and also permit selection of functional gRNAs that permit processing. Activity of a gRNA scaffold molecule may also be referred to herein as "function" of the gRNA. Thus, a gRNA that has a desired activity is one that functions in a desired manner. In some embodiments of the invention a functional gRNA scaffold is a gRNA that is capable of (1) directing nucleic acid binding and (2) processing. Systems and methods of the invention can be used to identify gRNA scaffold sequences that are capable of one or both of directing nucleic acid binding and processing.

DNA Binding Proteins

Components of used in screening assays of the invention and in multiplex nucleic acid target systems and methods of the invention include one or more DNA-binding proteins. In screening assays described herein a DNA binding protein may be used in systems and methods with which to test whether a nucleic acid is a gRNA scaffold and/or to assess the ability to process a gRNA.

A multiplex nucleic acid targeting system and method of the invention may include a gRNA scaffold array of the invention that comprises a one or more nucleic acid binding proteins, or functional variants thereof. In certain aspects of the invention, a nucleic acid binding protein is a DNA-binding protein and in certain aspects of the invention a nucleic acid binding protein is an RNA-binding protein. Non-limiting examples of types of nucleic acid DNA-binding proteins that may be used in some embodiments of systems and methods of the invention include: RNA-guided DNA-binding proteins and DNA-guided DNA-binding proteins. DNA binding proteins are known in the art, and include, but are not limited to: naturally occurring DNA binding proteins, a non-limiting example of which is a Cas9 protein, which has nuclease activity and cuts double stranded DNA. Cas9 proteins and Type II CRISPR systems are well documented in the art. (See for example, Makarova et al., Nature Reviews, Microbiology, Vol. 9, June 2011, pp. 467-477, the content of which is incorporated by reference herein in its entirety.) As used herein, the term "DNA binding protein having nuclease activity" refers to DNA binding proteins having nuclease activity and also functional variants thereof. A functional variant of a protein sequence differs in amino acid sequence from that sequence, referred to as the variant's "parent" sequence, while retaining from a least a portion to all of the nuclease activity of its parent protein.

In some embodiments, a method or system of the invention may comprise a DNA-guided DNA-binding nuclease. Information on identification and use of DNA-guided binding proteins, is available in the art (Gao, F., et al., Nature Biotech online publication, May 2, 2016: doi:10.1038/nbt.3547, the content of which is incorporated herein by reference in its entirety).

A DNA binding protein having nuclease activity function to cut double stranded DNA that may be used in aspects of methods of the invention can include DNA binding proteins that have one or more polypeptide sequences exhibiting nuclease activity. A DNA binding protein with multiple regions that have nuclease activity may comprise two separate nuclease domains, each of which functions to cut a particular strand of a double-stranded DNA. Polypeptide sequences that have nuclease activity are known in the art, and non-limiting examples include: a McrA-HNH nuclease related domain and a RuvC-like nuclease domain, or functional variants thereof. In *S. pyogenes*, a Cas9 DNA binding protein creates a blunt-ended double-stranded break that is mediated by two catalytic domains in the Cas9 binding protein: an HNH domain that cleaves the complementary strand of the DNA and a RuvC-like domain that cleaves the non-complementary strand. [See Jinke et al., Science 337, 816-821 (2012), the content of which is incorporated by reference herein in its entirety]. Cas9 proteins are known to exist in many Type II CRISPR systems, see for example, Makarova et al., Nature Reviews, Microbiology, Vol. 9, June 2011, pp. 467-477, supplemental information, the content of which is incorporated herein by reference in its entirety. The Cas9 protein may be referred by one of skill in the art in the literature as Csn1. Alternatives to Cas9 include but are not limited to Cpf1 proteins from Type V CRISPR systems (See for example Zetsche et al., Cpf1 Is a Single RNA-Guided Endonuclease of a Class 2 CRISPR-Cas System, Cell (2015), //dx.doi.org/10.1016/j.cell.2015.09.038). In certain aspects of the invention, a method or system of the invention includes a DNA binding protein that does not have nuclease activity.

In some embodiments of methods and systems of the invention an RNA-guided nucleic acid binding protein comprises a Cas protein. In some embodiments of the invention an RNA-guided nucleic acid binding protein comprises a Cas12a protein. Non-limiting examples of some art-known Cas12a proteins that may be used in embodiments of methods and systems of the invention are: AsCas12A (wild type), LbCas12a, LbCas12a(RR), or enAsCas12a.

Additional Components

Methods of the invention, in part, include identification, generation, and use of additional sequences that may be included in a vector delivered to a cell as part of a method or system of the invention. Sequences such as: promoter sequences, enhancer sequences, 3' untranslated region (3'UTR) sequences are non-limiting examples of additional sequences that may be included. One of skill in the art will understand how to include art-known components and conditions along with components detailed herein to prepare and use a screening method and/or system of the invention. Those skilled in the art will understand how to use identified gRNAs of the invention in gRNA scaffold arrays for use in multiplex nucleic acid targeting systems and methods in cells and organisms.

Target Genes

A target gene, also referred to herein as a target nucleic acid molecule, may be a preselected gene or preselected nucleic acid sequence, the expression of which is of interest to modify. Methods and systems of the invention can be used to modify expression of a target gene that encodes a protein of interest. In some embodiments of the invention, a target gene of interest is preselected because of a desire to alter expression of protein it encodes. In some embodiments, a plurality of preselected target genes may be independently identified, a minimally repetitive gRNA array prepared and used in a multiplex nucleic acid targeting system of the invention to modulate expression of the plurality of target genes. In such instances, each gRNA and spacer sequence in a unit may be preselected to target a preselected gene sequence. Thus, a plurality of units in a minimally repetitive gRNA array prepared using methods of the invention can be used in a multiplex nucleic acid targeting method of the invention to alter expression of a plurality of target genes. In some aspects of the invention a target gene or nucleic acid molecule is a double-stranded DNA molecule and in some embodiments of the invention a target nucleic acid is a single-stranded DNA molecule. A gene selected as target gene may be a nucleic acid sequence in the genome of a host cell.

In a multiplex nucleic acid targeting method or system of the invention, sequences encoding the gRNA array and one or more RNA-guided nucleic acid binding proteins may be expressed in a host cell, thereby modifying expression of the plurality of target genes and or target nucleic acid molecules. In certain instances, an expressed RNA-guided nucleic acid binding protein binds with a gRNA sequence of the minimally repetitive gRNA array and is directed to the selected target gene. Non-limiting examples of additional components that may be delivered into a host cell as part of a multiplex nucleic acid targeting method or system of the invention are one or more of: a promoter sequence, an enhancer sequence, a 3'UTR sequence, a reporter sequence, etc. Those of skill in the art will be able to select and include these and other additional components without based on art-known procedures and components used in CRISPER and other gene-editing systems. One or more design methods of the invention can be used to identify and select a target gene, and to design functional gRNAs capable of being cleaved/processed and that can be included in a multiplex nucleic acid targeting system or method of the invention in which they are capable of binding with, guiding, and positioning a DNA binding protein to a nucleic acid sequence adjacent to, or in close proximity to, a preselected target gene sequence.

Assays and screens described herein can be used to identify and assess guide RNA scaffolds and to determine whether the gRNA functions in a nucleic acid targeting system, and results in a desired effect on a preselected nucleic acid sequence (e.g., preselected target gene sequence). For example, though not intended to be limiting, if a desired effect on a preselected target gene is to reduce or eliminate expression of a preselected target gene, assays, screening methods, and systems of the invention can be used to determine whether one or more identified gRNA scaffold is capable of interacting with a binding protein in a manner effective to be processed, and capable of functioning to alter expression of the preselected target gene.

Guide Nucleic Acids

Methods of the invention, in part, include identifying, generating, and using gRNA scaffold molecules and minimally repetitive gRNA arrays in multiplex methods. Numerous gRNA molecules and methods of using the gRNA molecules in CRISPR-type systems are known in the art. In addition to gRNAs, some embodiments of the invention may include identifying and using guide DNA (gDNA) molecules. Information relating to guide DNAs can be found in Gao, F., et al., Nature Biotech online publication, May 2, 2016: doi:10.1038/nbt.3547, the content of which is incorporated herein by reference in its entirety. Guide RNAs may also be referred to herein and in the literature as short guide RNAs (sgRNAs), and as crRNAs for certain nucleases such as Cpf1. In general, a gRNA is designed and selected such that it is complementary to a DNA sequence of a selected target gene in the genome of a cell, wherein when the gRNA is present in the cell it is capable of binding a nucleic acid directed nucleic acid binding protein, or variant thereof and can direct modulation of a preselected target gene by the binding protein.

In some aspects of the invention methods of the invention may be used for one or more of identifying, screening, and determining functionality of, a component for use in a multiplex nucleic acid targeting method or system, which in some embodiments may be a multiplex CRISPR-based method or system. Components for use in a multiplex nucleic acid targeting system of the invention can be delivered into a host cell and expressed in the cell to produce a nucleic acid-guided nucleic acid binding protein and one or more functional sequences corresponding to protein-assisted RNA cleavage/processing, which in some embodiments of the invention are gRNA scaffold molecules. In a non-limiting example: a vector comprising a sequence encoding one or a plurality of gRNA scaffold molecules and an RNA-guided nucleic acid binding protein may be designed and delivered into a cell. Expression of the vector sequences in the host cell results in binding of the gRNA scaffold molecule to the RNA-guided nucleic acid binding protein, forming what is also referred to herein as a "riboprotein complex". The complex is directed by the gRNA to an independently preselected nucleic acid target sequence, where the complex co-localizes to, (also referred to herein as "binds") the target gene and the expression of the target gene is modified in a site-specific manner by the activity of the RNA guided nucleic acid binding protein.

In some embodiments the RNA-guided nucleic acid binding protein is an RNA-guided DNA binding protein. In some embodiments the RNA guided nucleic acid binding protein is a nuclease capable of cutting the independently preselected nucleic acid sequences. In a non-limiting example, in some embodiments of the invention an RNA-guided nucleic acid binding protein may be a Cas protein, which in some embodiments may be a Cas12a protein. Non-limiting examples of Cas12a proteins that may be included in embodiments of the invention are: AsCas12A (wild type), LbCas12a, LbCas12a(RR), and enAsCas12a, each of which is known in the art.

Methods of designing guide RNAs to direct an RNA-guided nucleic acid binding protein to a selected target gene are provided herein. Guide RNAs can be designed, prepared, tested, and selected for use in nucleic acid targeting systems and methods using one or more screening methods provided herein in conjunction with knowledge in the art relating to DNA binding, vector preparation and use, RNA-guided DNA binding proteins, CRISPR system components, and implementation, etc. In some embodiments, gRNAs of the invention can be used in arrays in multiplex nucleic acid targeting methods and systems. It has not previously been possible to produce highly divergent and diverse gRNAs for use in multiplex nucleic acid targeting methods and systems but methods and systems provided herein permit identification and implementation of functional divergent gRNAs that can be used in multiplexing methods. For example, though not intended to be limiting, methods of the invention can be used to design, construct, and implement a plurality of diverse/divergent gRNA that will bind an RNA-guided DNA nuclease. Methods of the invention also can be used to determine activity of the divergent/diverse gRNAs, for example, using a function-screening method or system of the invention to identify one or a plurality of gRNA scaffold molecules suitable for use in multiplex methods and systems of the invention.

It has previously been difficult or impossible to synthesize minimally repetitive gRNA sequences for use in multiplexing arrays. The presence of the number/extent of repetitive sequences in previous efforts in the art to prepare gRNA arrays, precluded efficient or rapid preparation of DNA sequences capable of expressing multiple gRNA sequences. The inability to avoid inclusion of repetitive sequences disrupted structure and utility of the gRNAs. Methods disclosed herein obviate this difficulty and permit rapid preparation of DNA sequences capable of expressing arrays comprising multiple gRNAs. Methods of the invention permit rapid identification and preparation of minimally repetitive sequences that encode gRNAs and functional gRNA arrays that can be used in multiplex systems. In some embodiments, components of a gRNA scaffold array of the invention are designed to minimize the length of sequences that are shared between different two or more different gRNAs in the array. Thus, identified gRNAs included in an array of the invention may be preselected in order to minimize the length of any sequences common to two or more of the selected gRNA scaffolds.

Non-limiting examples of guide RNAs designed using methods of the invention are set forth herein as SEQ ID NOs: 31-74. The length of a gRNA designed using methods of the invention may be at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more base pairs. It will be understood that a maximum or minimum permissible length of a gRNA is limited to a length at which the gRNA functions as a gRNA in a multiplex nucleic acid targeting method or system of the invention.

Design and Use of Divergent/Diverse RNA Sequences

The invention, in part, also relates to methods of preparing a readily synthesized double-stranded (ds) DNA sequence that can be used to produce multiple gRNAs, for example gRNA arrays. Multiple (or a plurality of) gRNAs can prepared such that they are able to direct a CRISPR-type protein (complex) to multiple target sites within a cell. Methods of the invention can be used to prepare divergent gRNA sequences that can be used in multiplex nucleic acid targeting methods and systems, to direct a plurality of RNA-guided nucleic acid binding proteins to a plurality of independently selected targets sequences within the same cell. The terms "divergent" and "diverse" are used interchangeably herein with respect to gRNA sequences/scaffolds and functional sequences corresponding to protein-assisted RNA cleavage/processing.

Certain embodiments of function-screening systems of the invention and processing screening systems of the invention can be used to identify diverse functional sequences corresponding to protein-assisted RNA cleavage/processing, such as but not limited to gRNA scaffolds, that can be used to generate minimally repetitive arrays of functional sequences corresponding to protein-assisted RNA cleavage/processing, for example, minimally repetitive gRNA scaffold arrays that can be used to target many sequences in the same cell. Minimally repetitive arrays prepared using methods of the invention are more easily synthesized and are more evolutionarily stable when encoded into cells and organisms compared to other previously known gRNA scaffolds and arrays. Certain embodiments of methods of the invention can be used to identify diverse gRNA scaffolds capable of constructing minimally repetitive arrays in a manner that permits matching a target sequence with a gRNA scaffold, thus permitting generation and use of diverse gRNA scaffold arrays that minimize secondary structure and maximize activity of the gRNA arrays in multiplex nucleic acid targeting methods and systems.

Divergent sequences may be prepared using methods of the invention for use in multiplex nucleic acid targeting systems and methods as disclosed herein, and also for other uses in cells and organisms. For example, methods of the invention to identify and generate divergent gRNA sequences can be used to prepare a plurality of sequences that have minimal sequence homology/identity between themselves and such gRNA scaffold arrays can be used for multi-targeting. As used herein, the term "multi-targeting" when used in the context of an array of divergent sequences means that the sequences are designed such that they target multiple different sequence sites, for example in a cell in which they are expressed. Effective multi-targeting can permit use of gRNA scaffolds and arrays of the invention in multiplex nucleic acid targeting methods and systems.

Multiplex Systems and Methods

An additional aspect of the invention comprises preparation and use of massively multiplex nucleic acid targeting systems and methods, for example massively multiplex virus targeting systems and methods. Methods of identifying gRNA scaffolds and minimally repetitive gRNA scaffold arrays as set forth herein, can be used to prepare effective multiplex nucleic acid targeting systems. For example, gRNA scaffolds can be identified and used to generate minimally repetitive gRNA scaffold arrays. These arrays can be used in conjunction with systems of the invention that are capable of multiplex nucleic acid targeting and gene editing. A non-limiting example of a method of using multiplexing nucleic acid targeting system comprising one or more gRNAs of the invention, is multiplex nucleic acid targeting that confers viral immunity in a cell and/or organism. In this example, methods and systems of the invention are used to identify gRNA scaffolds and gRNA scaffold arrays that, in a cell and or subject are capable of (1) targeting one or more specific sequences important for viral infection in the subject and (2) altering an activity of the targeted sequence, thereby conferring to the cell and/or subject, immunity to the virus. Certain embodiments of methods and systems of the invention can be used to design, prepare, and implement massively multiplexed nucleic acid targeting systems capable of conferring immunity one, two, or a plurality of different viruses.

The invention, in part also includes guide RNA (gRNA) scaffold molecules capable of both RNA-processing and Cas12a-directed DNA-binding (e.g. enabling multiplexing) for different enzymes. Non-limiting examples of enzymes with this gRNA scaffold molecules of the invention can be used are: ASCas12 (wildtype), LBCas12a; LbCas12a(RR); and enAsCas12a. Certain embodiments of the invention include compositions that include one or more of the gRNA scaffold molecules of the invention. Sequences of gRNA scaffold molecules of the invention are set forth herein as SEQ ID NO: 31-74 in Table 1. Tables 2-5 provide sequences of identified gRNA scaffold molecules of the invention that bind Cas proteins: AsCas12a (wild type), LbCas12a, LbCas12a(RR), and/or enAsCas12a. Table 2 provides gRNa scaffold molecules that bind enAsCas12a protein. Table 3 provides sequences of gRNA scaffold molecules that bind LbCas12a(RR) protein. Table 4 provides sequences of gRNA scaffold molecules that bind AsCas12a (wild type) protein. Table 5 provides sequences of gRNA scaffold molecules that bind LbCas12a protein.

Tables 6-9 provide consensus sequences for identified gRNA scaffold molecules that bind indicated Cas proteins: AsCas12a (wild type), LbCas12a, LbCas12a(RR), and enAsCas12a protein. Table 6 provides consensus sequences for identified gRNA scaffold molecules that bind enAsCas12a protein. Table 7 provides consensus sequences for identified gRNA scaffold molecules that bind LbCas12a (RR) protein. Table 8 provides consensus sequences for identified gRNA scaffold molecules that bind AsCas12a (wild type) protein. Table 9 provides consensus sequences for identified gRNA scaffold molecules that bind LbCas12a protein. Tables 10-13 provide additional consensus sequences for identified gRNA scaffold molecules that bind indicated Cas proteins. Table 10 provides consensus sequences for identified gRNA scaffold molecules that bind enAsCas12a protein. Table 11 provides consensus sequences for identified gRNA scaffold molecules that bind AsCas12a (wild type) protein. Table 12 provides consensus sequences for identified gRNA scaffold molecules that bind LbCas12a protein. Table 13 provides consensus sequences for identified gRNA scaffold molecules that bind LbCas12a(RR) protein. In Tables 6-13 IUPAC nucleotide codes are used in the sequences. According to IUPAC codes: A is Adenine; C is Cytosine; G is Guanine, T (or U) Thymine (or Uracil), R is A or G; Y is C or T; S is G or C; W is A or T; K is G or T; M is A or C; B is C or G or T; D is A or G or T; H is A or C or T; V is A or C or G; and N is any base.

It will be understood that the sequences identified herein as gRNA scaffold sequences are isolated nucleic acid sequences that are not part of a longer natural sequence. The gRNA sequences set forth herein as SEQ ID Nos: 2-3280 may be in a vector and still be considered isolated, as they are not part of a natural longer molecule. A gRNA molecule of the invention such as one set forth in Tables 1-13, may be in a composition. The composition may also include a vector and the gRNA molecule may be included in the vector.

In some embodiments a composition comprising a gRNA scaffold molecule of the invention further comprises a vector sequence. In some embodiments of the invention one or more gRNA scaffold molecules of the invention are in a vector. gRNA scaffold molecules of the invention have been identified and shown to result in fold enrichment for RNA-processing and Cas12a-directed DNA-binding (e.g. enabling multiplexing). Both RNA-processing and Cas12a-directed DNA-binding are required for multiplexing per the "Broken Array" assay (see Example 5).

Table 1 provides identified gRNA sequences. N=A, T, G, or C

```
SEQ ID NO: 31    NAATTTCTACTNNNGTAGAT
SEQ ID NO: 32    NAATTTCTACTAAGTGTAGAT
SEQ ID NO: 33    NCATTTCTACTAAGTGTAGAT
SEQ ID NO: 34    NACTTTCTACTAAGTGTAGAT
SEQ ID NO: 35    NCCTTTCTACTAAGTGTAGAT
SEQ ID NO: 36    NAATTTCTACCAAGTGTAGAT
SEQ ID NO: 37    NAATTTCTACTNAGTGTAGAT
SEQ ID NO: 38    NAATTTCTACTANGTGTAGAT
SEQ ID NO: 39    NAATTTCTACTAANTGTAGAT
SEQ ID NO: 40    NAATTTCTACTAANGGTAGAT
SEQ ID NO: 41    NAATTTCTACTAAGTGTAGGT
SEQ ID NO: 42    NAATTTCTACTAAGTGTGGAT
SEQ ID NO: 43    NAATTTATACTAAGTGTATAT
SEQ ID NO: 44    NAATTTCTCCTAAGTGTAGGT
SEQ ID NO: 45    NAATTTCTGCTAAGTGTAGGT
SEQ ID NO: 46    NAATTTCGACTAAGTGTCGAT
SEQ ID NO: 47    NAATTTCTACTAAGTGCAGAT
SEQ ID NO: 48    NAATTTCTATTAAGTGTAGAT
SEQ ID NO: 49    NAATTTATACTACGGTATAT
SEQ ID NO: 50    NAATTTATACTATCGTATAT
SEQ ID NO: 51    NAATTTATACTTTGTGATAT
SEQ ID NO: 52    NAATTTCTGCTACAGCAGAT
SEQ ID NO: 53    NAATTTCTGCTACCGCAGAT
SEQ ID NO: 54    NAATTTCTGCTACGGCAGAT
SEQ ID NO: 55    NAATTTCTGCTACTGCAGAT
SEQ ID NO: 56    NAATTTCTGCTAGCGCAGAT
SEQ ID NO: 57    NAATTTCTGCTATNGCAGAT
SEQ ID NO: 58    NAATTTCTGCTCTAGCAGAT
SEQ ID NO: 59    NAATTTCTCCTAAAGGAGAT
SEQ ID NO: 60    NAATTTCTCCTAATGGAGAT
SEQ ID NO: 61    NAATTTCTCCTACNGGAGAT
SEQ ID NO: 62    NAATTTCTCCTAGAGGAGAT
SEQ ID NO: 63    NAATTTCTCCTAGTGGAGAT
SEQ ID NO: 64    NAATTTCTCCTATNGGAGAT
SEQ ID NO: 65    NAATTTCTCCTCATGGAGAT
SEQ ID NO: 66    NAATTTCTCCTCCAGGAGAT
SEQ ID NO: 67    NAATTTCTCCTCCTGGAGAT
SEQ ID NO: 68    NAATTTCTCCTCTNGGAGAT
SEQ ID NO: 69    NAATTTCTCCTGTTGGAGAT
SEQ ID NO: 70    NAATTTCTCCTTCAGGAGAT
SEQ ID NO: 71    NAATTTCTCCTTCTGGAGAT
SEQ ID NO: 72    NAATTTCTCCTTGTGGAGAT
SEQ ID NO: 73    NAATTTCTCCTTTTGGAGAT
SEQ ID NO: 74    NAATTTCTACCNNNGTAGAT
```

Table 2 provides identified en_as gRNA sequences that bind enAsCas12a protein.

| SEQ ID NO | gRNA Sequence |
| --- | --- |
| 77 | CAATTTCTACTCTTGTAGAT |
| 78 | AAATTGTTGTTCTTACAGCT |
| 79 | CAATTATTTGTAAGTTGAATT |
| 80 | CAATTTCTCCTCTTGGAGAT |
| 81 | CAATTGTGTTTAAGTAGTATT |
| 82 | AAATTATGCCTCTTGGTATT |
| 83 | AAATTAGCATTCTTGTGCTT |
| 84 | GAATTACCGTTAAGTATGGTT |
| 85 | CAATTCCTACTCTTGTAGGT |
| 86 | AAATTCCTACTCTTGTAGGT |
| 87 | CAATTGGTGCTCTTGTGCTT |
| 88 | AAATTATCGCTCTTGTGGTT |
| 89 | AAATTGATGCTAAGTGTGTCT |
| 90 | GAATTAAGTGTAAGTTGTTTT |
| 91 | CAATTGGGGTTCTTGCCCTT |
| 92 | GAATTTCGGTTAAGTGTCGGT |
| 93 | AAATTCGATCTAAGTGATCGT |
| 94 | CAATTATGTGTAAGTTGTATT |
| 95 | GAATTATCCGTCTTCGGGTT |
| 96 | GAATTGCTGTTAAGTACAGCT |
| 97 | GAATTCGGCTTAAGTAGCTGT |
| 98 | GAATTCTTCCTCTTGGAAGT |

-continued

| SEQ ID NO | gRNA Sequence |
|---|---|
| 99 | CAATTAGACGTAAGTCGTCTT |
| 100 | AAATTGGCGCTCTTGTGTCT |
| 101 | AAATTTGTCATAAGTTGGCGT |
| 102 | CAATTCAATCTAAGTGGTTGT |
| 103 | AAATTCGGTGTCTTCGTCGT |
| 104 | AAATTGGACGTCTTCGTTCT |
| 105 | GAATTGGATGTCTTTGTCTT |
| 106 | CAATTGTTGGTCTTCTAGTT |
| 107 | GAATTCGGCATCTTTGCTGT |
| 108 | GAATTTGTTGTAAGTTAACAT |
| 109 | CAATTGGTGGTAAGTCCGCCT |
| 110 | GAATTGTATGTCTTCATGCT |
| 111 | CAATTGAGTGTAAGTTATTTT |
| 112 | CAATTGGGGCTCTTGCTCTT |
| 113 | CAATTCGTCTTAAGTAGACGT |
| 114 | AAATTTGCGTTCTTGCGTAT |
| 115 | AAATTGGTAGTAAGTCTATTT |
| 116 | CAATTGACGATAAGTTCGTTT |
| 117 | GAATTCGTCTTAAGTAGGCGT |
| 118 | AAATTGCTGCTCTTGTGGCT |
| 119 | GAATTCATGGTCTTTTGTGT |
| 120 | CAATTGGTGGTCTTTTGCCT |
| 121 | AAATTGTGTGTAAGTCATGTT |
| 122 | CAATTGGTGCTCTTGCACTT |
| 123 | GAATTGGCTATCTTTGGTCT |
| 124 | CAATTGACGGTCTTCCGTTT |
| 125 | CAATTTTTGGTAAGTTCGGGT |
| 126 | AAATTGCTGTTCTTACAGTT |
| 127 | GAATTGTTAGTAAGTTTGGCT |
| 128 | GAATTGTGGCTCTTGTTGCT |
| 129 | CAATTACTTTTCTTAAGGTT |
| 130 | CAATTGGGACTAAGTGTCCTT |
| 131 | GAATTCCTGTTAAGTGCAGGT |
| 132 | AAATTTGGTGTCTTTGTTAT |
| 133 | CAATTGTTTGTAAGTTGGGCT |
| 134 | CAATTGGTTGTCTTCAACCT |
| 135 | CAATTAACCCTAAGTGGGTTT |
| 136 | CAATTGATGGTCTTTCGTCT |
| 137 | GAATTGCGTCTCTTGGTGCT |
| 138 | AAATTTCGCGTAAGTCGTGGT |
| 139 | CAATTTTGATTAAGTATTAAT |
| 140 | CAATTTCTGGTCTTCTGGAT |
| 141 | CAATTGGCACTAAGTGTGCCT |
| 142 | GAATTCGGGTAAGTCTCGGT |
| 143 | CAATTGTCCTTAAGTAGGGTT |
| 144 | CAATTAAACGTAAGTCGTTTT |
| 145 | AAATTCGGTCTAAGTGGCCGT |
| 146 | CAATTCCCGTCTTTGGGGT |
| 147 | CAATTCGTCTTCTTAGATGT |
| 148 | CAATTACTGATCTTTTAGTT |
| 149 | CAATTTTCGGTAAGTTCGAAT |
| 150 | CAATTGGGTGTCTTCATTCT |
| 151 | CAATTACGGGTCTTTCTGTT |
| 152 | CAATTAGGGATAAGTTCCCTT |
| 153 | CAATTAGGACTAAGTGTTCTT |
| 154 | AAATTACCTGTCTTTAGGTT |
| 155 | AAATTGGCCGTCTTCGGTCT |
| 156 | CAATTATGGGTCTTTCTGTT |
| 157 | CAATTAGACGTCTTCGTCTT |
| 158 | GAATTATGCATCTTTGCGTT |
| 159 | CAATTCCTGTTCTTGCGGGT |
| 160 | CAATTCGGCTTCTTGGCTGT |
| 161 | AAATTGTGTCTCTTGATGCT |
| 162 | CAATTCTGTGTCTTTGCGGT |
| 163 | CAATTGGTTCTCTTGGATCT |
| 164 | GAATTGCACGTCTTTGTGCT |
| 165 | CAATTGTGTCTCTTGGTACT |
| 166 | CAATTTGCGCTCTTGTGTGT |
| 167 | CAATTGTGTATAAGTTGTGCT |
| 168 | CAATTATTGCTCTTGTGGTT |
| 169 | CAATTTCCCGTCTTCGGGAT |
| 170 | GAATTTTCGTTAAGTGTGGGT |
| 171 | GAATTACGGCTCTTGTCGTT |
| 172 | CAATTGGCGTTCTTATGCCT |
| 173 | CAATTGTTGGTAAGTCCAACT |
| 174 | CAATTTCAGGTAAGTCCTGGT |

-continued

| SEQ ID NO | gRNA Sequence |
|---|---|
| 175 | CAATTAGGATTCTTGTTTTT |
| 176 | CAATTGTGCGTAAGTTGCGCT |
| 177 | CAATTGGTCCTCTTGGACCT |
| 178 | CAATTGCGAGTAAGTTTTGCT |
| 179 | CAATTGTGCGTCTTTGTGTT |
| 180 | CAATTGTTGTTCTTGCAACT |
| 181 | GAATTGCCCTTCTTGGGGTT |
| 182 | CAATTCCTTCTAAGTGAAGGT |
| 183 | CAATTGTCGGTAAGTCTGGTT |
| 184 | CAATTAGGGATAAGTTCCTTT |
| 185 | GAATTGCATGTCTTCATGTT |
| 186 | CAATTAGGTTTCTTGACCTT |
| 187 | CAATTATGCTTCTTAGTATT |
| 188 | CAATTTCGTGTCTTTGTGGT |
| 189 | CAATTTTCGCTCTTGCGGGT |
| 190 | CAATTATCGTTAAGTGCGGTT |
| 191 | CAATTAGTGATCTTTTACTT |
| 192 | CAATTGTTCGTCTTCGAGCT |
| 193 | CAATTAGTGGTAAGTCCGTTT |
| 194 | CAATTCTGGCTAAGTGCCGGT |
| 195 | CAATTGTTGCTCTTGTGGCT |
| 196 | CAATTTCATGTAAGTCATGGT |
| 197 | CAATTATTTGTAAGTCAGGTT |
| 198 | CAATTGTTGCTAAGTGCAATT |
| 199 | CAATTGGTTTCTTAGTTCT |
| 200 | CAATTAGCTCTAAGTGGGTTT |
| 201 | CAATTGCTTATCTTTAAGCT |
| 202 | CAATTTACATTCTTGTGTGT |
| 203 | CAATTTCAGTTCTTGCTGAT |
| 204 | CAATTGGCGTTCTTGTGCTT |
| 205 | GAATTGTGCGTAAGTTGCGTT |
| 206 | CAATTTTATTTCTTGATGAT |
| 207 | CAATTATAATTAAGTGTTATT |
| 208 | CAATTGCGCATAAGTTGTGTT |
| 209 | CAATTGGTGATCTTTCGCCT |
| 210 | CAATTGTGTGTCTTCGTGCT |
| 211 | CAATTATTGCTAAGTGCAATT |
| 212 | CAATTTGCTGTCTTCAGTGT |

-continued

| SEQ ID NO | gRNA Sequence |
|---|---|
| 213 | CAATTGATGTTCTTGCGTCT |
| 214 | CAATTGTTGATAAGTTCGACT |
| 215 | GAATTCGTTCTCTTGAGCGT |
| 216 | CAATTCGTTGTCTTTGACGT |
| 217 | CAATTTCTTGTCTTCGGGGT |
| 218 | CAATTTGGTATAAGTTGTTGT |
| 219 | CAATTGAGCGTCTTCGCTCT |
| 220 | CAATTAGGTCTAAGTGACCTT |
| 221 | CAATTGTGCTTCTTGGTGTT |
| 222 | CAATTCGGGTTAAGTGTTCGT |
| 223 | CAATTTTGGGTCTTCCTGGT |
| 224 | GAATTTGTGGTAAGTTCGCGT |
| 225 | CAATTAGATCTAAGTGATCTT |
| 226 | CAATTGCGGTTAAGTACTGCT |
| 227 | CAATTGCGCGTAAGTTGTGTT |
| 228 | CAATTGTAGTTCTTGCTACT |
| 229 | GAATTGGCGTTCTTACGTCT |
| 230 | CAATTATTCTTAAGTGGGGTT |
| 231 | CAATTCGCTGTAAGTCAGTGT |
| 232 | CAATTTGTGCTAAGTGCGCAT |
| 233 | GAATTCCGTTTCTTGACGGT |
| 234 | CAATTGCGACTAAGTGTCGTT |
| 235 | CAATTGGGGTTCTTATCCCT |
| 236 | CAATTCGGGCTCTTGCTCGT |
| 237 | CAATTCATCCTCTTGGGTGT |
| 238 | CAATTGGCTCTAAGTGAGTCT |
| 239 | AAATTTCGGGTAAGTCTCGGT |
| 240 | CAATTGCGACTCTTGTTGTT |
| 241 | CAATTGGTCGTCTTTGATTT |
| 242 | CAATTCCTGATAAGTTTGGGT |
| 243 | CAATTGTGCATAAGTTGTGTT |
| 244 | CAATTGTGCGTAAGTCGCGTT |
| 245 | CAATTGGCGTTCTTATGTCT |
| 246 | CAATTAAGCATCTTTGCTTT |
| 247 | CAATTATGGTTCTTGCCGTT |
| 248 | GAATTGTGCCTAAGTGGCGTT |
| 249 | CAATTCTCTGTAAGTCAGAGT |
| 250 | CAATTCGTGTTAAGTGTGTGT |

| SEQ ID NO | gRNA Sequence |
|---|---|
| 251 | CAATTCGCTTTAAGTGAGTGT |
| 252 | CAATTCTACCTAAGTGGTGGT |
| 253 | CAATTATTCTTCTTAGAGTT |
| 254 | CAATTAGTATTCTTATGCTT |
| 255 | CAATTGCGTTTAAGTGATGCT |
| 256 | CAATTGGACGTAAGTCGTCCT |
| 257 | CAATTGAGAGTCTTTTCTTT |
| 258 | CAATTCGTGTTCTTGTGTGT |
| 259 | CAATTACTTTTAAGTGGAGTT |
| 260 | CAATTATCGCTCTTGCGGTT |
| 261 | CAATTGGTACTCTTGTGTTT |
| 262 | CAATTACGTGTAAGTCACGTT |
| 263 | CAATTTGTGATCTTTCGTAT |
| 264 | CAATTGTGCCTCTTGGTACT |
| 265 | CAATTTATGCTCTTGCGTAT |
| 266 | AAATTCGGTCTAAGTGATCGT |
| 267 | CAATTTGGGATAAGTTCCCAT |
| 268 | CAATTTTGGCTCTTGTCGAT |
| 269 | CAATTTCGAGTAAGTCTCGGT |
| 270 | CAATTCAACGTCTTCGTTGT |
| 271 | CAATTGGCTGTCTTTAGCCT |
| 272 | CAATTGGTGCTAAGTGTGCCT |
| 273 | CAATTACGTGTAAGTCGTGTT |
| 274 | CAATTGGTTGTCTTCAGCCT |
| 275 | CAATTTGGGTTCTTGCTCGT |
| 276 | CAATTGGGGGTAAGTCTTCTT |
| 277 | CAATTTCGTCTCTTGACGGT |
| 278 | CAATTGTGCTTAAGTAGCGTT |
| 279 | CAATTTACCTTCTTGGGTGT |
| 280 | CAATTCGGCATAAGTTGTCGT |
| 281 | CAATTTATGGTAAGTTTATGT |
| 282 | CAATTGATTGTCTTTGATCT |
| 283 | GAATTGCGACTAAGTGTCGCT |
| 284 | CAATTAGTTTTCTTGGATTT |
| 285 | CAATTGCGTCTAAGTGACGTT |
| 286 | CAATTAAGTTTCTTGGTTTT |
| 287 | CAATTGGTGTTAAGTGCATTT |
| 288 | CAATTACTGATAAGTTTGGTT |

| SEQ ID NO | gRNA Sequence |
|---|---|
| 289 | CAATTGGACATCTTTGTCCT |
| 290 | CAATTTGTTTTCTTAAACGT |
| 291 | CAATTTGACCTCTTGGTCAT |
| 292 | CAATTCCACGTCTTCGTGGT |
| 293 | AAATTCATGTTAAGTACGTGT |
| 294 | CAATTTTACGTCTTCGTGAT |
| 295 | CAATTGACGCTAAGTGCGTCT |
| 296 | CAATTCGATGTCTTTGTCGT |
| 297 | CAATTCCGTGTCTTTGCGGT |
| 298 | CAATTGCGGTTAAGTGCCGCT |
| 299 | CAATTGGTGTTCTTGCGCTT |
| 300 | CAATTCATCGTCTTTGATGT |
| 301 | CAATTTTTGTTAAGTGCGAGT |
| 302 | CAATTAGGCTTAAGTGGCCTT |
| 303 | CAATTGGGGCTAAGTGTCTCT |
| 304 | CAATTGGCTTTCTTAGGCCT |
| 305 | CAATTACGCGTCTTCGTGTT |
| 306 | GAATTGCGGGTCTTCTCGCT |
| 307 | CAATTCTGCGTCTTCGTAGT |
| 308 | CAATTCGCGGTAAGTCCGTGT |
| 309 | CAATTACGCGTAAGTTGCGTT |
| 310 | CAATTAAGTGTAAGTCATTTT |
| 311 | CAATTTGGTTTAAGTGATCGT |
| 312 | CAATTTGAGTTCTTGTTCGT |
| 313 | CAATTGTCGTTAAGTGCGACT |
| 314 | CAATTGTTTTTAAGTGGGGCT |
| 315 | CAATTTCACGTAAGTTGTGAT |
| 316 | CAATTTGTGATAAGTTCACGT |
| 317 | CAATTTCGTTTAAGTGATGGT |
| 318 | CAATTTTTCGTCTTTGGGAT |
| 319 | CAATTATCCTTCTTAGGGTT |
| 320 | CAATTCGCGATCTTTTGTGT |
| 321 | CAATTAAGTTTCTTGGCTTT |
| 322 | CAATTTTGGTCTTCCAAAT |
| 323 | CAATTCACGTTAAGTATGTGT |
| 324 | CAATTGCTTGTCTTCGAGCT |
| 325 | AAATTGTGCGTAAGTCGTGCT |
| 326 | CAATTGTGGGTCTTCCTATT |

| SEQ ID NO | gRNA Sequence |
|---|---|
| 327 | CAATTTGACGTCTTCGTCAT |
| 328 | CAATTTGGTGTAAGTCATCGT |
| 329 | CAATTGTCGTTAAGTACGGTT |
| 330 | CAATTGCTGGTAAGTCTAGTT |
| 331 | CAATTGGTCCTCTTGGGTCT |
| 332 | CAATTCTGCGTCTTCGTGGT |
| 333 | CAATTCTTGTTCTTGTGAGT |
| 334 | CAATTTGCCCTCTTGGGCGT |
| 335 | CAATTGGGGGTCTTTTCCCT |
| 336 | CAATTGACGCTCTTGCGTCT |
| 337 | CAATTTGCGTTAAGTACGCAT |
| 338 | CAATTTCAAGTCTTTTTGAT |
| 339 | CAATTGCAGTTCTTGTTGCT |
| 340 | CAATTGTATGTAAGTCGTGCT |
| 341 | CAATTGGGGGTAAGTCCTTCT |
| 342 | CAATTATGGTTCTTACCGTT |
| 343 | CAATTTTGTGTCTTCACGAT |
| 344 | CAATTACTTATCTTTGAGTT |
| 345 | CAATTATGGGTAAGTCTCATT |
| 346 | AAATTCGTGCTAAGTGTGCGT |
| 347 | CAATTGTGCCTCTTGGTGCT |
| 348 | CAATTGTGTGTAAGTCGCGCT |
| 349 | CAATTTTGGCTAAGTGCTAAT |
| 350 | CAATTAGCCTTCTTGGGTTT |
| 351 | CAATTACGTGTCTTCGTGTT |
| 352 | CAATTGTTGCTCTTGCGATT |
| 353 | CAATTCGTGTTCTTACGCGT |
| 354 | CAATTGGTTCTCTTGGGCCT |
| 355 | CAATTAACGTTCTTGCGTTT |
| 356 | CAATTAGATTTCTTGGTCTT |
| 357 | CAATTGCCGCTAAGTGCGGTT |
| 358 | CAATTCGGTATCTTTGTCGT |
| 359 | CAATTTGCAGTCTTCTG CAT |
| 360 | CAATTTAAGTTCTTGTTTGT |
| 361 | CAATTGTTTTAAGTGAGGCT |
| 362 | CAATTGGTTGTCTTCAGTCT |
| 363 | CAATTTGCGTTAAGTGCGCAT |
| 364 | CAATTTCGGTTAAGTGTCGGT |
| 365 | CAATTGGTCATCTTTGACTT |
| 366 | CAATTGCGTCTCTTGGTGCT |
| 367 | CAATTTTTGTTAAGTGTAGGT |
| 368 | CAATTGTGTGTAAGTTATGTT |
| 369 | GAATTGTGTATCTTTGCGCT |
| 370 | CAATTGGACGTCTTTGTTTT |
| 371 | GAATTCGCGCTAAGTGTGCGT |
| 372 | CAATTACTTTTCTTGAGGTT |
| 373 | CAATTCCGGGTAAGTCTTGGT |
| 374 | CAATTGAACCTAAGTGGTTCT |
| 375 | AAATTGGTGCTAAGTGCGCCT |
| 376 | CAATTGTGGTTCTTACTATT |
| 377 | CAATTTCTGATCTTTTGGGT |
| 378 | CAATTATTGCTAAGTGCGATT |
| 379 | CAATTTTGCCTCTTGGCAAT |
| 380 | CAATTGTGGTTAAGTGCTGTT |
| 381 | CAATTGCGTCTCTTGATGCT |
| 382 | CAATTTGGTGTCTTTATCGT |
| 383 | CAATTGTTGGTCTTCCAGTT |
| 384 | CAATTGGCTGTCTTTGGCCT |
| 385 | CAATTGGCTCTCTTGAGTCT |
| 386 | CAATTACGGGTCTTCCTGTT |
| 387 | GAATTAGTGTTCTTGCGCTT |
| 388 | CAATTTGTCGTCTTCGGCAT |
| 389 | CAATTGCGTTTAAGTGACGCT |
| 390 | CAATTCCTGATCTTTTAGGT |
| 391 | GAATTTCGGTTAAGTGCTGGT |
| 392 | CAATTGGGTATCTTTGCTCT |
| 393 | CAATTGGCTCTAAGTGAGTTT |
| 394 | CAATTTGTGTTAAGTATACAT |
| 395 | CAATTGCGTGTCTTTATGTT |
| 396 | CAATTGTTGTTCTTACGG CT |
| 397 | CAATTGGGGTTAAGTGCCCTT |
| 398 | CAATTGCGTTTAAGTGACGTT |
| 399 | CAATTGCATGTAAGTCGTGTT |
| 400 | CAATTGGCGGTCTTTCGCCT |
| 401 | CAATTCAGGCTCTTGTCTGT |
| 402 | GAATTCCTGCTCTTGTAGGT |

| SEQ ID NO | gRNA Sequence |
|---|---|
| 403 | CAATTCGCATTAAGTGTGCGT |
| 404 | CAATTACTGGTCTTCTAGTT |
| 405 | CAATTGGCTTTAAGTGAGTTT |
| 406 | AAATTTGTCATCTTTGGTGT |
| 407 | CAATTGGTGTTCTTATGCTT |
| 408 | CAATTTGTTGTAAGTCGACAT |
| 409 | CAATTGTATCTCTTGATACT |
| 410 | CAATTTTGGTTAAGTGCCGGT |
| 411 | CAATTGGTTTTCTTGGACTT |
| 412 | CAATTGTGTGTCTTCGTGTT |
| 413 | CAATTATGCGTAAGTCGTGTT |
| 414 | CAATTTGGCGTCTTTGTCGT |
| 415 | CAATTGCTCGTAAGTCGAGTT |
| 416 | CAATTCGCAATCTTTTGCGT |
| 417 | CAATTCGGCTTAAGTAGTTGT |
| 418 | CAATTCATGTTCTTACGTGT |
| 419 | CAATTGTATCTAAGTGATACT |
| 420 | GAATTTGCGTTCTTGCGTAT |
| 421 | CAATTTGCAATCTTTTGCGT |
| 422 | AAATTGTCGTTAAGTGCGGTT |
| 423 | CAATTAGCGCTCTTGCGCTT |
| 424 | CAATTTAAGGTCTTCCTTAT |
| 425 | CAATTGCGGTTAAGTGTCGTT |
| 426 | CAATTATGTGTAAGTCATGTT |
| 427 | GAATTCCGACTAAGTGTTGGT |
| 428 | CAATTCGTGATCTTTTGCGT |
| 429 | CAATTCTTCGTAAGTCGAAGT |
| 430 | CAATTCGTGTTCTTATGCGT |
| 431 | CAATTGCGCCTAAGTGGTGCT |
| 432 | CAATTGCGTATCTTTGCGTT |
| 433 | CAATTGTGTCTCTTGACGTT |
| 434 | CAATTATGTCTCTTGGTGTT |
| 435 | CAATTCCGCGTCTTTGTGGT |
| 436 | CAATTGTTTATCTTTGGACT |
| 437 | CAATTTTGCGTCTTCGTAGT |
| 438 | CAATTCACCGTAAGTTGGTGT |
| 439 | CAATTGCTTGTAAGTCAGGCT |
| 440 | CAATTGCTTTTCTTAGGGCT |
| 441 | AAATTGTGCTTCTTGGCGCT |
| 442 | AAATTGTTGCTCTTGCGACT |
| 443 | CAATTGCGTATCTTTGCGCT |
| 444 | CAATTGGTGTTAAGTGCGTTT |
| 445 | CAATTGCGCATCTTTGCGTT |
| 446 | CAATTATGTGTCTTCGCGTT |
| 447 | CAATTACGTATCTTTGCGTT |
| 448 | CAATTTGGTGTAAGTCGTCGT |
| 449 | CAATTTGTTGTAAGTCGGCGT |
| 450 | GAATTAGCGTTAAGTACGTTT |
| 451 | CAATTTCCGGTAAGTTCGGGT |
| 452 | CAATTCGTTCTCTTGAACGT |
| 453 | CAATTATGCATCTTTGTGTT |
| 454 | CAATTGCGCCTAAGTGGCGTT |
| 455 | CAATTCGCTATCTTTGGCGT |
| 456 | CAATTCCGTGTAAGTCGCGGT |
| 457 | CAATTGTGGGTCTTTCCGTT |
| 458 | CAATTTGTGGTCTTTTATAT |
| 459 | CAATTCATCGTCTTCGGTGT |
| 460 | GAATTCCATGTAAGTTGTGGT |
| 461 | CAATTAGACCTAAGTGGTCTT |
| 462 | CAATTGTTTGTCTTTGAGCT |
| 463 | CAATTCCGTCTCTTGACGGT |
| 464 | CAATTCGCCGTCTTCGGTGT |
| 465 | CAATTTGCTATAAGTTGGTAT |
| 466 | CAATTGTGGGTCTTTTCACT |
| 467 | CAATTGCACTTCTTGGTGCT |
| 468 | CAATTCAGAGTCTTCTTTGT |
| 469 | CAATTTTTGCTAAGTGTGGGT |
| 470 | GAATTGTTCGTCTTCGAGCT |
| 471 | CAATTCGCTATCTTTAGCGT |
| 472 | CAATTGGGTCTAAGTGATCCT |
| 473 | CAATTGTTGTTCTTGTGGCT |
| 474 | CAATTTTGTGTCTTCACGGT |
| 475 | CAATTCGTTGTAAGTCGGTGT |
| 476 | CAATTCGCCTTAAGTAGGCGT |
| 477 | CAATTTTTACTCTTGTGAGT |
| 478 | CAATTTGGGGTCTTTCCCAT |

-continued

| SEQ ID NO | gRNA Sequence |
|---|---|
| 479 | CAATTCAGTGTAAGTCACTGT |
| 480 | CAATTGGCGTTCTTACGCTT |
| 481 | CAATTAAGATTCTTGTTTTT |
| 482 | CAATTGACGTTCTTACGTTT |
| 483 | CAATTAGATGTAAGTCGTCTT |
| 484 | CAATTTCGACTAAGTGTCGGT |
| 485 | CAATTTTGATTAAGTGTTGAT |
| 486 | CAATTCGACGTCTTCGTCGT |
| 487 | CAATTGAACGTAAGTCGTTCT |
| 488 | CAATTGGCACTAAGTGTGTCT |
| 489 | GAATTCGCCGTAAGTCGGTGT |
| 490 | CAATTCGATGTCTTCATTGT |
| 491 | CAATTCTGTGTAAGTCGCAGT |
| 492 | AAATTCCGCGTCTTCGTGGT |
| 493 | GAATTGAGCCTAAGTGGTTCT |
| 494 | AAATTGCGTCTCTTGACGTT |
| 495 | CAATTGGTTTAAGTGGATCT |
| 496 | AAATTCGCTCTCTTGGGTGT |
| 497 | CAATTTACGTTCTTGCGTAT |
| 498 | CAATTTACGTTCTTACGTAT |
| 499 | CAATTGCCTCTCTTGGGGCT |
| 500 | CAATTGTGGGTAAGTCCCGCT |
| 501 | CAATTGTCGGTAAGTTCGGCT |
| 502 | CAATTGGGGTTAAGTGCCCCT |
| 503 | CAATTAGAGTTCTTGTTCTT |
| 504 | CAATTGTACGTCTTCGTGCT |
| 505 | CAATTTACGTTAAGTACGTAT |
| 506 | CAATTCGGCATAAGTTGTTGT |
| 507 | CAATTTGGTATAAGTTGCTGT |
| 508 | CAATTACTTGTCTTCGAGTT |
| 509 | CAATTGCCGCTCTTGTGGCT |
| 510 | CAATTGTGTGTCTTTACGCT |
| 511 | CAATTTGTGCTCTTGCACGT |
| 512 | GAATTGTTTGTCTTCGAACT |
| 513 | CAATTGTGGTTAAGTGCCGTT |
| 514 | GAATTGAAGGTAAGTCCTTTT |
| 515 | CAATTGTGTGTCTTCACGCT |
| 516 | CAATTGCCTGTCTTTAGGCT |

| SEQ ID NO | gRNA Sequence |
|---|---|
| 517 | CAATTTTTGGTCTTCTGGAT |
| 518 | CAATTATTAGTCTTCTAGTT |
| 519 | AAATTGGTCGTCTTCGACCT |
| 520 | CAATTATTAGTCTTTTAGTT |
| 521 | CAATTCATGCTCTTGTGTGT |
| 522 | CAATTGCGTGTAAGTTGCGTT |
| 523 | CAATTGAGGTTCTTACTTTT |
| 524 | CAATTACCAATCTTTTGGTT |
| 525 | AAATTGTCCATAAGTTGGACT |
| 526 | CAATTTGTGTTAAGTACATGT |
| 527 | CAATTGCCTGTAAGTCAGGTT |
| 528 | CAATTGTTGTCTTCGATAT |
| 529 | CAATTCTCGTTCTTGTGGGT |
| 530 | CAATTGCGCCTCTTGGCGTT |
| 531 | CAATTGGTGTTAAGTGTACTT |
| 532 | CAATTACGTGTCTTTATGTT |
| 533 | CAATTGCCATTCTTGTGGCT |
| 534 | CAATTTGTAGTAAGTCTGTAT |
| 535 | CAATTGCGCGTAAGTTGCGCT |
| 536 | CAATTTGACGTCTTCGTCGT |
| 537 | CAATTTGACCTCTTGGTCGT |
| 538 | CAATTGCGTGTCTTTGCGTT |
| 539 | GAATTGTCCGTCTTCGGGCT |
| 540 | CAATTGGTTGTCTTCGGCCT |
| 541 | CAATTTCGTGTCTTCACGAT |
| 542 | CAATTTCGTGTCTTCATGGT |
| 543 | CAATTCAGTGTCTTCGTTGT |
| 544 | CAATTGTAGTTAAGTGTTACT |
| 545 | GAATTGTGTTAAGTATGCGT |
| 546 | CAATTTGGGTTCTTGCCCAT |
| 547 | CAATTGTTGCTAAGTGCGGTT |
| 548 | CAATTGCGCGTCTTCGTGCT |
| 549 | CAATTTGCACTAAGTGTGCAT |
| 550 | CAATTTATGTTAAGTATGTGT |
| 551 | GAATTGCGTTTCTTGACGCT |
| 552 | CAATTCGGTCTAAGTGGTTGT |
| 553 | CAATTCGCGTTAAGTGCGCGT |
| 554 | CAATTTGGCCTAAGTGGTTGT |

| SEQ ID NO | gRNA Sequence |
|---|---|
| 555 | CAATTCGGGTTCTTATTTGT |
| 556 | CAATTGCCTCTAAGTGGGGTT |
| 557 | GAATTTACGTTCTTACGTAT |
| 558 | CAATTTGTGATCTTTTGTGT |
| 559 | CAATTCGCGCTCTTGTGCGT |
| 560 | CAATTTGTAGTAAGTCTACAT |
| 561 | CAATTCGTTGTCTTCAGTGT |
| 562 | CAATTTGTCGTAAGTCGGCGT |
| 563 | GAATTTAGCTTCTTGGCTGT |
| 564 | CAATTGTACGTCTTTGTGCT |
| 565 | CAATTTCTTGTAAGTTGGGAT |
| 566 | CAATTCGGTTTAAGTAGCCGT |
| 567 | CAATTCGCAGTAAGTTTGCGT |
| 568 | CAATTTTGGTTAAGTGTTAAT |

Table 3 provides identified RR_lb gRNA sequences that bind LbCas12a(RR) protein.

| SEQ ID NO | gRNA Sequence |
|---|---|
| 569 | GAATTTCTTCTAAGTGAAGAT |
| 570 | AAATTTCTACTAGAGTGTAGAT |
| 571 | GAATTTCTACTTGCTTGTAGAT |
| 572 | AAATTTCTACTATTCAGTAGAT |
| 573 | AAATTTCTACTTGCTGTAGAT |
| 574 | CAATTTCTACTTTGCGTAGAT |
| 575 | CAATTTCTACTAAGTGTAGAT |
| 576 | AAATTTCTACTCCGCCGTAGAT |
| 577 | CAATTTCTACTTCAATGTAGAT |
| 578 | CAATTTCTACTAGATTGTAGAT |
| 579 | GAATTTCTACTTAGAGTAGAT |
| 580 | GAATTTCTCCTATCGTGGAGAT |
| 581 | GAATTTCTACTCGGCGTAGAT |
| 582 | GAATTTCTACTTTAGTAGAT |
| 583 | AAATTTCTACTACAAGTAGAT |
| 584 | GAATTTCTACTTAGGTAGAT |
| 585 | AAATTTCTACTGCTTGTAGAT |
| 586 | GAATTTCTACTAGTGTGTAGAT |
| 587 | AAATTTCTACTGTGGTGTAGAT |
| 588 | AAATTCCTTCTAAGTGAAGGT |
| 589 | CAATTTCTACTACCGAGTAGAT |
| 590 | GAATTTCTACTGTCGGGTAGAT |
| 591 | GAATTTCTACTGTTGTGTAGAT |
| 592 | GAATTTCTACTATGATGTAGAT |
| 593 | GAATTTCTACTTCAACGTAGAT |
| 594 | GAATTTCTACTGCGATGTAGAT |
| 595 | CAATTCCTCGTAAGTCGAGGT |
| 596 | GAATTTCTACTATCATGTAGAT |
| 597 | GAATTTCTACTAACGTGTAGAT |
| 598 | AAATTTCTACTAGGCGTAGAT |
| 599 | GAATTTCTACTATAAGGTAGAT |
| 600 | AAATTTCTACTACAGCGTAGAT |
| 601 | AAATTTCTCCTAGTCGGAGAT |
| 602 | CAATTTCTACTATGGGGTAGAT |
| 603 | GAATTTCTACTACAGTGTAGAT |
| 604 | GAATTTCTACTGGCCAGTAGAT |
| 605 | GAATTTCTACTATACTGTAGAT |
| 606 | CAATTCTCCTAGGGCGGAGAT |
| 607 | GAATTTCTACTTCTCCGTAGAT |
| 608 | CAATTTCTACTAGGCGTAGAT |
| 609 | CAATTTCTACTGTTTGGTAGAT |
| 610 | CAATTCTACTTCACGTAGAT |
| 611 | AAATTTCTACTACTGTGTAGAT |
| 612 | CAATTTCTACTGTTTAGTAGAT |
| 613 | AAATTTCTACTTCGCCGTAGAT |
| 614 | AAATTTCTACTGCTGTGTAGAT |
| 615 | CAATTTCTACTTCTATGTAGAT |
| 616 | CAATTTCTACTAGGGCGTAGAT |
| 617 | GAATTTCTACTAGGCGTAGAT |
| 618 | GAATTTCTACTTGGAGTAGAT |
| 619 | GAATTTCTACTAGCGAGTAGAT |
| 620 | AAATTTCTACTAATGGGTAGAT |
| 621 | GAATTTCTACTGAAGGGTAGAT |
| 622 | CAATTTCTACTCGGGTAGAT |
| 623 | AAATTTCTACTCCTGTAGAT |
| 624 | GAATTTCTACTAATCTGTAGAT |
| 625 | GAATTTCTACTGGCGAGTAGAT |
| 626 | GAATTTCTCCTTCGTGGAGAT |
| 627 | GAATTTCTACTGGTTGTAGAT |
| 628 | GAATTTCTACTCATCGGTAGAT |
| 629 | GAATTTCTACTCGATCGTAGAT |

-continued

| | |
|---|---|
| 630 | AAATTTCTACTTTCAGGTAGAT |
| 631 | CAATTTCTACTACGGGTAGAT |
| 632 | AAATTCCTGCTAAGTGCAGGT |
| 633 | GAATTTCTACTTGATAGTAGAT |
| 634 | CAATTTCTACTG GAG CGTAGAT |
| 635 | CAATTTCTACTCTAGGGTAGAT |
| 636 | GAATTTCTACTCCGGTGTAGAT |
| 637 | CAATTTCTACTATTTGTAGAT |
| 638 | AAATTTCTACTTGCCTGTAGAT |
| 639 | CAATTTCTCCTAAGATGGAGAT |
| 640 | GAATTTCTACTTACTGGTAGAT |
| 641 | GAATTTCTACTACGCGTAGAT |
| 642 | GAATTTCTCCTATAGTGGAGAT |
| 643 | CAATTTCTACTTTTCTGTAGAT |
| 644 | CAATTTCTCCTACAGTGGAGAT |
| 645 | CAATTTCTACTGGTGCGTAGAT |
| 646 | GAATTTCTACTGTAGAGTAGAT |
| 647 | GAATTTCTACTTCTGCGTAGAT |
| 648 | CAATTTCTACTATGCGTAGAT |
| 649 | AAATTTCTACTTAACTGTAGAT |
| 650 | GAATTTCTACTAAGTGTAGAT |
| 651 | GAATTTCTACTGGCCCGTAGAT |
| 652 | GAATTTCTCCTATGTTGGAGAT |
| 653 | GAATTGACTCTCTTGGGTTT |
| 654 | GAATTTCTACTCAGTCGTAGAT |
| 655 | CAATTTCTACTAGCTTGTAGAT |
| 656 | CAATTTCTACTGACAGTAGAT |
| 657 | GAATTTCTACTATCTGTAGAT |
| 658 | AAATTTCTACTACGCGGTAGAT |
| 659 | CAATTTCTACTAGGGGTAGAT |
| 660 | AAATTTCTACTAGTACGTAGAT |
| 661 | AAATTTCTACTGGATTGTAGAT |
| 662 | CAATTTCTACTACGTGTAGAT |
| 663 | CAATTTCTACTATAGTGTAGAT |
| 664 | CAATTTCTACTATGGGTAGAT |
| 665 | GAATTATGTGTAAGTCACGTT |
| 666 | GAATTTCTACTCTCGTAGAT |
| 667 | GAATTTCTACTTCTTTGTAGAT |
| 668 | CAATTTCTACTTTAGTGTAGAT |
| 669 | GAATTTCTACTAGTAGTAGAT |
| 670 | AAATTTCTACTGCACTGTAGAT |
| 671 | CAATTTCTACTATAGCGTAGAT |
| 672 | AAATTTCTACTAGGATGTAGAT |
| 673 | CAATTTCTACTATGAGTAGAT |
| 674 | CAATTTCTACTGTGGTAGAT |
| 675 | AAATTTCTACTATAGGGTAGAT |
| 676 | GAATTTCTACTGAGTGGTAGAT |
| 677 | CAATTTCTACTCTAGTAGAT |
| 678 | CAATTTCTACTACCAAGTAGAT |
| 679 | AAATTTCTACTGGCAGTAGAT |
| 680 | GAATTTCTCCTATCCGGAGAT |
| 681 | CAATTTCTACTGAAAGTAGAT |
| 682 | GAATTTCTCCTATCGCGGAGAT |
| 683 | CAATTTCTACTCCTAAGTAGAT |
| 684 | GAATTTCTACTACTGAGTAGAT |
| 685 | GAATTTCTACTAGTCTGTAGAT |
| 686 | CAATTTCTACTTCTCTGTAGAT |
| 687 | AAATTTCTACCACTTGTAGAT |
| 688 | CAATTTCTACTTGTTCGTAGAT |
| 689 | GAATTTCTACTCACACGTAGAT |
| 690 | CAATTTCTCCTATAGAGGAGAT |
| 691 | GAATTTCTACTACCCCGTAGAT |
| 692 | GAATTTCTACTGCCGAGTAGAT |
| 693 | GAATTTCTACTCACTAGTAGAT |
| 694 | GAATTTCTACTCAAACGTAGAT |
| 695 | GAATTTCTACTCTCTTGTAGAT |
| 696 | AAATTTCTACTCTTCGGTAGAT |
| 697 | GAATTTCTACTCGGTAGTAGAT |
| 698 | GAATTTCTACTCCGGCGTAGAT |
| 699 | CAATTTCTCCTAGATGGAGAT |
| 700 | GAATTTCTACTGCCGTGTAGAT |
| 701 | AAATTTCTCCTATGGGAGAT |
| 702 | GAATTTCTACTATACCGTAGAT |
| 703 | AAATTTCTCCTAACTTGGAGAT |
| 704 | CAATTTCTACTATGTGTAGAT |
| 705 | GAATTTCTACTAGGTGTAGAT |
| 706 | GAATTTCTACTGACAAGTAGAT |
| 707 | GAATTTCTACACCAAAGTAGAT |
| 708 | CAATTTCTACTAATTTGTAGAT |
| 709 | CAATTTCTACTAAACCGTAGAT |
| 710 | CAATTTCTACTTCAGGTAGAT |

| | |
|---|---|
| 711 | GAATTTCTCCTCAAACGGAGAT |
| 712 | GAATTTCTACTGTTGAGTAGAT |
| 713 | CAATTTCTCCTATTTGGAGAT |
| 714 | AAATTTCTACTCCGTGGTAGAT |
| 715 | AAATTTCTACTTCAGTGTAGAT |
| 716 | AAATTTCTCCTAGGTTGGAGAT |
| 717 | GAATTTCTACCAACTTGTAGAT |
| 718 | CAATTTCTACTACGCGTAGAT |
| 719 | GAATTTCTACTTGAGTGTAGAT |
| 720 | GAATTTCTACTGATTGGTAGAT |
| 721 | AAATTTCTACTGCGAGTAGAT |
| 722 | AAATTTGTCTTCTTAGGTGT |
| 723 | CAATTTCTACTTGAGAGTAGAT |
| 724 | CAATTTCTACTATACGGTAGAT |
| 725 | GAATTTCTACTGAGATGTAGAT |
| 726 | CAATTTCTACTTGTGGTAGAT |
| 727 | CAATTTCTACTGGCACGTAGAT |
| 728 | AAATTTCTCCTAAAGCGGAGAT |
| 729 | GAATTTCTACTCGCTGTAGAT |
| 730 | CAATTTCTACTCTTTCGTAGAT |
| 731 | GAATTTCTACTACGAGTAGAT |
| 732 | AAATTTCTACTGCGCCGTAGAT |
| 733 | CAATTTCTACCAAATGTAGAT |
| 734 | GAATTTCTACTAGTGGTAGAT |
| 735 | GAATTTCTACTTTAACGTAGAT |
| 736 | GAATTTCTACTTCGCAGTAGAT |
| 737 | CAATTTCTACTCCGTCGTAGAT |
| 738 | GAATTTCTACTCCGTTGTAGAT |
| 739 | GAATTTCTCCTGTGCGGAGAT |
| 740 | CAATTTCTACTATTGAGTAGAT |
| 741 | GAATTTCTACTCTTACGTAGAT |
| 742 | CAATTTCTACTGAGACGTAGAT |
| 743 | CAATTTCTACTAAGGAGTAGAT |
| 744 | AAATTTCTACTAAGCGTAGAT |
| 745 | GAATTTCTACTCTGGGTAGAT |
| 746 | CAATTTCTACTGTGGTGTAGAT |
| 747 | AAATTTCTACTCTTCAGTAGAT |
| 748 | CAATTTCTACTGTTGGGTAGAT |
| 749 | AAATTTCTCCTACCAGGAGAT |
| 750 | CAATTTCTCCTAAGGGGAGAT |
| 751 | GAATTTCTACTTCATAGTAGAT |
| 752 | CAATTTCTACTCGACCGTAGAT |
| 753 | CAATTTCTACTTATGGTAGAT |
| 754 | AAATTTCTACTGAATCGTAGAT |
| 755 | AAATTTCTACTAAGGGTAGAT |
| 756 | GAATTTCTACTTGTAGTAGAT |
| 757 | CAATTTCTACTTCCGTGTAGAT |
| 758 | CAATTTCTACTCACCGTAGAT |
| 759 | CAATTTACAATCTTTTGTGT |
| 760 | CAATTTCTACTCGATAGTAGAT |
| 761 | CAATTTCTACTAAGAGTAGAT |
| 762 | CAATTTCTACTTTTGTAGAT |
| 763 | CAATTTCTACTATGGTAGAT |
| 764 | AAATTTCTACTCCCACGTAGAT |
| 765 | CAATTTCTACTCAGGCGTAGAT |
| 766 | GAATTTCTCCTAGTGTGGAGAT |
| 767 | CAATTCTCCTTCTTGGGGT |
| 768 | GAATTTCTACTGGAGCGTAGAT |
| 769 | GAATTTCTCCTAACGCGGAGAT |
| 770 | CAATTTCTACTAGATCGTAGAT |
| 771 | AAATTTCTACTCTGGGTAGAT |
| 772 | CAATTTCTACTACGGGTAGAT |
| 773 | GAATTTCTACTTGTAAGTAGAT |
| 774 | CAATTTCTACTTGAGGGTAGAT |
| 775 | GAATTTCTACTAAGCGTAGAT |
| 776 | CAATTTCTACTAGAGGGTAGAT |
| 777 | GAATTTCTACTCCTGCGTAGAT |
| 778 | CAATTTCTACTAGGTGGTAGAT |
| 779 | CAATTTCTCCTACATGGAGAT |
| 780 | CAATTTCTACTTCAGGGTAGAT |
| 781 | CAATTTCTACTCGGTGTAGAT |
| 782 | GAATTTCTACTAAGAGGTAGAT |
| 783 | CAATTTCTACTCCGGCGTAGAT |
| 784 | CAATTTCTACTCTATCGTAGAT |
| 785 | CAATTTCTACTGCCAGTAGAT |
| 786 | CAATTTCTACTAGTGTGTAGAT |
| 787 | CAATTTCTACTTCTCGTAGAT |
| 788 | CAATTTCTCCTCTGAGGAGAT |
| 789 | CAATTTCTACTAATGTGTAGAT |
| 790 | GAATTTCTACTCGTGGGTAGAT |
| 791 | CAATTTCTACTGAGATGTAGAT |

| | |
|---|---|
| 792 | GAATTTCTACTACCGTGTAGAT |
| 793 | CAATTTCTACTCATGGTAGAT |
| 794 | CAATTTCTACTAAAGGTAGAT |
| 795 | GAATTTCTACTCTCATGTAGAT |
| 796 | CAATTTCTACTATCCGTAGAT |
| 797 | CAATTTCTCCTTATGTGGAGAT |
| 798 | CAATTTCTACTGAGCGTAGAT |
| 799 | CAATTTCTACTGTTGGTAGAT |
| 800 | CAATTTCTACTAGGTGTAGAT |
| 801 | CAATTTCTACTAGCAGGTAGAT |
| 802 | GAATTAGCGATAAGTTCGCTT |
| 803 | AAATTTCTACTCAGCAGTAGAT |
| 804 | CAATTTCTACTATCCGGTAGAT |
| 805 | GAATTTCTACTATTGTAGAT |
| 806 | CAATTTCTACTGTGGCGTAGAT |
| 807 | GAATTTCTACTATCGAGTAGAT |
| 808 | CAATTTCTACTCTCTAGTAGAT |
| 809 | CAATTTCTACTTAGGTGTAGAT |
| 810 | CAATTCCTCCTAAGTGGAGGT |
| 811 | CAATTTCTACTACCTGTAGAT |
| 812 | CAATTTCTACTTTAGCGTAGAT |
| 813 | AAATTTCTACCCGAGGTAGAT |
| 814 | GAATTTCTACTGACCCGTAGAT |
| 815 | GAATTTCTACTACAGGTAGAT |
| 816 | GAATTTCTACTTAGTGTAGAT |
| 817 | GAATTTCTACTCGTACGTAGAT |
| 818 | CAATTTCTACTTCGGGTAGAT |
| 819 | AAATTTCTACTACGCGTAGAT |
| 820 | CAATTTCTACCACTAGTAGAT |
| 821 | AAATTTCTCCTACGTGGAGAT |
| 822 | GAATTTCTACTGTTTTGTAGAT |
| 823 | CAATTTCTACTTCGTGGTAGAT |
| 824 | GAATTTCTACTGCGTGGTAGAT |
| 825 | GAATTTCTACTTCAAGGTAGAT |
| 826 | AAATTTCTACTTGTCAGTAGAT |
| 827 | GAATTTCTACTACAACGTAGAT |
| 828 | GAATTTCTACTTGCTCGTAGAT |
| 829 | GAATTTCTACTCTTCAGTAGAT |
| 830 | AAATTTTGACTAAGTGTCGAT |
| 831 | GAATTTGCACTAAGTGTGTGT |
| 832 | CAATTTCTCCTATTCCGGAGAT |
| 833 | CAATTTCTACTATCTGTAGAT |
| 834 | AAATTTCTACTACGGGTAGAT |
| 835 | CAATTTCTACTAGGCAGTAGAT |
| 836 | CAATTTCTACTTTCTTGTAGAT |
| 837 | CAATTTCTACTACGAAGTAGAT |
| 838 | GAATTTCTACTAATTGTAGAT |
| 839 | GAATTTCTACTCGCCAGTAGAT |
| 840 | CAATTTCTACTTTCCCGTAGAT |
| 841 | GAATTTCTCCGTTTCAGGAGAT |
| 842 | AAATTTCTACTCCGCGTAGAT |
| 843 | CAATTTCTACTGAAGTGTAGAT |
| 844 | CAATTTCTACTAACACGTAGAT |
| 845 | GAATTTCTCCTACCTTGGAGAT |
| 846 | GAATTTCTACTTGTGTAGAT |
| 847 | GAATTTCTACTTCTAAGTAGAT |
| 848 | AAATTTCTCCTGTTGGAGAT |
| 849 | CAATTTCTCCTATTTCGGAGAT |
| 850 | CAATTTCTACTACAGGTAGAT |
| 851 | CAATTTCTACTAGCGGGTAGAT |
| 852 | CAATTCTCCTAGTAGGAGAT |
| 853 | CAATTTCTACTCCCGGGTAGAT |
| 854 | GAATTTCTACTGCAGTGTAGAT |
| 855 | AAATTTCTCCTATGTGGAGAT |
| 856 | GAATTTCTACTGGAGTGTAGAT |
| 857 | GAATTTCTACTATTTTGTAGAT |
| 858 | GAATTTCTACTCCTCTGTAGAT |
| 859 | CAATTTCTACTATGGTGTAGAT |
| 860 | AAATTTCTACTTATGCGTAGAT |
| 861 | CAATTTCTCCTACAGGAGAT |
| 862 | AAATTTCTACTTGAGTAGAT |
| 863 | CAATTTCTACTGCAGGTAGAT |
| 864 | CAATTTCTACTGGGGTAGAT |
| 865 | GAATTTCTACTGTCAAGTAGAT |
| 866 | CAATTTCTACTACGAGTAGAT |
| 867 | GAATTTCTCCTGGTGTGGAGAT |
| 868 | CAATTTGTGATAAGTTCGCGT |
| 869 | AAATTTCTACTTTCCCGTAGAT |
| 870 | CAATTTCTACTAAGTAGTAGAT |
| 871 | AAATTTCTACTACAGGTAGAT |
| 872 | CAATTTCTACTGAACTGTAGAT |

-continued

| | |
|---|---|
| 873 | CAATTTCTACTGACTGTAGAT |
| 874 | GAATTTCTACTAATCAGTAGAT |
| 875 | CAATTTCTACTCCACTGTAGAT |
| 876 | GAATTAAGGTTCTTGTCTTT |
| 877 | GAATTTCTACTCCCCGGTAGAT |
| 878 | GAATTTCTACTGGAACGTAGAT |
| 879 | CAATTTCTACTGATGCGTAGAT |
| 880 | AAATTTCTACCAGTCGTAGAT |
| 881 | GAATTTCTACTCCTCGTAGAT |
| 882 | CAATTTCTACTGAGTTGTAGAT |
| 883 | CAATTTCTACTAGGCTGTAGAT |
| 884 | GAATTTCTACTTCACGGTAGAT |
| 885 | AAATTTCTACTATAAGGTAGAT |
| 886 | CAATTTCTACTAGGAGTAGAT |
| 887 | AAATTGTCGGTAAGTCCGGCT |
| 888 | CAATTTCTACTCCTTAGTAGAT |
| 889 | CAATTTCTACTCCAGGTAGAT |
| 890 | CAATTTCTACTGGGTGTAGAT |
| 891 | GAATTTCTACTGAAGTAGAT |
| 892 | GAATTTCTACTCGCACGTAGAT |
| 893 | AAATTTCTACTGCGTAGTAGAT |
| 894 | CAATTTCTACTCAGGTGTAGAT |
| 895 | CAATTTCTCCTACGTGGAGAT |
| 896 | CAATTTCTACTATACTGTAGAT |
| 897 | GAATTTCTACTCAGGCGTAGAT |
| 898 | AAATTTCTACTGCCGTAGAT |
| 899 | AAATTTCTACTCCGAAGTAGAT |
| 900 | CAATTTCTCCTATCGCGGAGAT |
| 901 | GAATTTCTACTGCTGGGTAGAT |
| 902 | CAATTTCTACTTGGCGTAGAT |
| 903 | GAATTTCTACTCCTAGGTAGAT |
| 904 | AAATTTCGACTAAGTGTTGAT |
| 905 | CAATTTCTACTCCCTTGTAGAT |
| 906 | CAATTTCTACTGATTAGTAGAT |
| 907 | CAATTTCTACTCTGTAGTAGAT |
| 908 | CAATTTCTACTCTTATGTAGAT |
| 909 | GAATTTCTACTGCAGAGTAGAT |
| 910 | CAATTTCACCTAAGTGGTGAT |
| 911 | AAATTGTACGTCTTTGTGCT |
| 912 | GAATTTCTACTCGAACGTAGAT |

-continued

| | |
|---|---|
| 913 | CAATTTCTACTCCCCCGTAGAT |
| 914 | AAATTTCTACTGCCCAGTAGAT |
| 915 | CAATTTCTCCTACACGGAGAT |
| 916 | CAATTTCTCCTAATGCGGAGAT |
| 917 | CAATTTCTACTGTCCAGTAGAT |
| 918 | CAATTTCTACTAATCGTAGAT |
| 919 | CAATTTCTACTATGCTGTAGAT |
| 920 | AAATTTCTACCGTTACGTAGAT |
| 921 | CAATTTCTACTTAGCTGTAGAT |
| 922 | CAATTTCTACTGTCCTGTAGAT |
| 923 | CAATTTCTCCTACCTTGGAGAT |
| 924 | CAATTTCTACCAACTTGTAGAT |
| 925 | AAATTTCTCCTAGACGGAGAT |
| 926 | GAATTTCTACTCGTGTAGAT |
| 927 | CAATTTCTACCATTTGTAGAT |
| 928 | GAATTTCTACTATCGTGTAGAT |
| 929 | CAATTTCTACTTCCACGTAGAT |
| 930 | AAATTTCTCCTAAGGGGAGAT |
| 931 | CAATTTCTACTAAAACGTAGAT |
| 932 | CAATTTCTACTATCGTGTAGAT |
| 933 | GAATTCCTCCTCTTGGAGGT |
| 934 | CAATTTCTACTAATGGGTAGAT |
| 935 | AAATTTCTACTTCCCGTAGAT |
| 936 | CAATTTCTACTATGAGGTAGAT |
| 937 | CAATTCCTTGTCTTCGGGGT |
| 938 | CAATTTCTACTAGATGTAGAT |
| 939 | CAATTTCTACTTTTGAGTAGAT |
| 940 | GAATTTCTACTCAGTGTAGAT |
| 941 | GAATTTCTACTAAAGGGTAGAT |
| 942 | CAATTTCTACTACCACGTAGAT |
| 943 | CAATTTCTACTATGTTGTAGAT |
| 944 | CAATTTCTACTATTCTGTAGAT |
| 945 | CAATTTCTACTGTATCGTAGAT |
| 946 | AAATTTCTACTGCTCGTAGAT |
| 947 | CAATTTCTACTTTGACGTAGAT |
| 948 | GAATTTCTCCTAAATTGGAGAT |
| 949 | GAATTTCTACTCGGGTAGAT |
| 950 | CAATTTCTCCTATCTGGAGAT |
| 951 | GAATTTCTACTATCTAGTAGAT |
| 952 | CAATTTCTCCTACGATGGAGAT |
| 953 | CAATTTCTACTTGGTGGTAGAT |

| | |
|---|---|
| 954 | CAATTTCTACCTATGCGTAGAT |
| 955 | CAATTTCTACTGCGATGTAGAT |
| 956 | CAATTTCTACTTTGAAGTAGAT |
| 957 | CAATTTCTACTCATGCGTAGAT |
| 958 | CAATTTCTACCTTTTGGTAGAT |
| 959 | CAATTTCTACTAATCGGTAGAT |
| 960 | GAATTTCTACTACGCGGTAGAT |
| 961 | CAATTTCTACTCCTTTGTAGAT |
| 962 | CAATTCCTGTTCTTGTGGGT |
| 963 | AAATTTCTACTTTGTGGTAGAT |
| 964 | CAATTTCTACTGTTGTGTAGAT |
| 965 | CAATTTCTACTGACTGGTAGAT |
| 966 | GAATTTCTACTCTTGTGTAGAT |
| 967 | CAATTTCTACTTTGATGTAGAT |
| 968 | GAATTTCTACTGATCAGTAGAT |
| 969 | CAATTTCTACTTACAGTAGAT |
| 970 | GAATTTCTACTGCTTTGTAGAT |
| 971 | GAATTTCTACTTCCCTGTAGAT |
| 972 | CAATTTCTACTGTTTCGTAGAT |
| 973 | CAATTTCTACTTCGCAGTAGAT |
| 974 | GAATTCCGCCTAAGTGGCGGT |
| 975 | GAATTTCTACTGGGGTAGAT |
| 976 | CAATTTCTCCTAAGTGGAGAT |
| 977 | CAATTTCTACTCAGGTAGAT |
| 978 | GAATTTCTACAACATCGTAGAT |
| 979 | CAATTTCTCCTAGGAGGAGAT |
| 980 | CAATTTTGACTAAGTGTCGAT |
| 981 | CAATTTCTCCTACATCGGAGAT |
| 982 | CAATTTCTACTTGACGTAGAT |
| 983 | CAATTTCTCCTAGTGGAGAT |
| 984 | GAATTTCTACTGGGACGTAGAT |
| 985 | GAATTTCTACTTGGTGTAGAT |
| 986 | CAATTTCTACTATTCGGTAGAT |
| 987 | AAATTTCTACTCTTGCGTAGAT |
| 988 | AAATTTCTACTCTGGAGTAGAT |
| 989 | GAATTTCTACTCTGGTGTAGAT |
| 990 | GAATTTCTACTGACGTGTAGAT |
| 991 | AAATTTCTACTAGAGCGTAGAT |
| 992 | CAATTTCTCCTATCCGGAGAT |
| 993 | CAATTTCTCCTACGAGGAGAT |
| 994 | CAATTTCTACTACACTGTAGAT |
| 995 | GAATTTCTACTCTGCCGTAGAT |
| 996 | CAATTTCTACTGCAGCGTAGAT |
| 997 | CAATTTCTACTAGCAAGTAGAT |
| 998 | GAATTTCTACTGTCGTAGAT |
| 999 | CAATTTCTCCTATCAGGAGAT |
| 1000 | GAATTTCTACTCAATTGTAGAT |
| 1001 | CAATTTCTCCTAAGGAGGAGAT |
| 1002 | CAATTTCTACTCTCGAGTAGAT |
| 1003 | GAATTTCTACTGCTTGTAGAT |
| 1004 | CAATTTCTACTTGTTGGTAGAT |
| 1005 | CAATTTCTACTTAGGTAGAT |
| 1006 | CAATTTCTACTTCGCCGTAGAT |
| 1007 | CAATTTCTACTACTTTGTAGAT |
| 1008 | GAATTTCTACTTTTCGGTAGAT |
| 1009 | CAATTTCTACTACATAGTAGAT |
| 1010 | CAATTTCTACTAGTGGTAGAT |
| 1011 | CAATTTCTACTCACTAGTAGAT |
| 1012 | CAATTTCTACTTTAGTAGAT |
| 1013 | CAATTTCTTCTAAGTGAAGAT |
| 1014 | CAATTTCTACTCGAGTAGAT |
| 1015 | CAATTTCTACTTGGCAGTAGAT |
| 1016 | GAATTTCTACTGCCATGTAGAT |
| 1017 | CAATTTCTACTACTTCGTAGAT |
| 1018 | AAATTTCTACTCAGTCGTAGAT |
| 1019 | CAATTTCTCCTGTGAGGAGAT |
| 1020 | CAATTTCTACTGTGTGTAGAT |
| 1021 | CAATTTCTACTTCTGGTAGAT |
| 1022 | CAATTTCTACTACCCGGTAGAT |
| 1023 | CAATTTCTACTCGTGCGTAGAT |
| 1024 | CAATTTCTACTGGTGTAGAT |
| 1025 | CAATTAGCGGTCTTTTGCTT |
| 1026 | GAATTTCTACTTGGCGTAGAT |
| 1027 | CAATTTCTGCTAAGTGTAGAT |
| 1028 | GAATTTCTACTCTCGTGTAGAT |
| 1029 | CAATTTCTCCTAACAGGAGAT |
| 1030 | AAATTTCTACTGTGTGGTAGAT |
| 1031 | AAATTTCTACTAGCGAGTAGAT |
| 1032 | CAATTTCTACTATGCAGTAGAT |
| 1033 | CAATTTCTACTAAGGGGTAGAT |
| 1034 | CAATTTCTACTGCAGAGTAGAT |

| | |
|---|---|
| 1035 | GAATTTCTACTTAGTTGTAGAT |
| 1036 | CAATTTCTACTTACCGTAGAT |
| 1037 | CAATTTCTCCTACTGGGAGAT |
| 1038 | GAATTTCTACGAACTAGTAGAT |
| 1039 | CAATTTCTACTACAGTGTAGAT |
| 1040 | CAATTTCTACTGCTGTAGAT |
| 1041 | CAATTTCTACTACTGTAGAT |
| 1042 | CAATTTCTACTTAGAAGTAGAT |
| 1043 | AAATTTCTACTCAAGTGTAGAT |
| 1044 | CAATTTCTACTTTGGCGTAGAT |
| 1045 | AAATTTCTACTTGTGAGTAGAT |
| 1046 | GAATTTCTACTCCTACGTAGAT |
| 1047 | GAATTTCTACGCATGGTAGAT |
| 1048 | CAATTTCTCCTTCGTGGAGAT |
| 1049 | GAATTTCTCCTAAATGGAGAT |
| 1050 | GAATTTCTCCTACCGTGGAGAT |
| 1051 | CAATTTCTCCTGTTGTGGAGAT |
| 1052 | CAATTTCTCCTAGCAGGAGAT |
| 1053 | AAATTTCTACTGGCGAGTAGAT |
| 1054 | CAATTTCTACTGGATAGTAGAT |
| 1055 | CAATTTCTACTCTCTTGTAGAT |
| 1056 | CAATTTCTACTTAGTAGTAGAT |
| 1057 | CAATTTCTACTTCCGCGTAGAT |
| 1058 | CAATTTCTCCTACAAGGAGAT |
| 1059 | CAATTTCTACTTGTAGGTAGAT |
| 1060 | GAATTTCTACTGGGCTGTAGAT |
| 1061 | CAATTTCTACTCGTTCGTAGAT |
| 1062 | GAATTTCTACTACCCGTAGAT |
| 1063 | CAATTTCTACTAGCATGTAGAT |
| 1064 | CAATTTACCTTAAGTAGGTGT |
| 1065 | CAATTTCTACTCCGTGTAGAT |
| 1066 | CAATTCTGTTTCTTAACG GT |
| 1067 | GAATTTCTACGAGTAGTAGAT |
| 1068 | CAATTTCTACTAGTAGTAGAT |
| 1069 | CAATTTCTACTAACGCGTAGAT |
| 1070 | CAATTTCTACTGTCATGTAGAT |
| 1071 | CAATTTCTACTACACGTAGAT |
| 1072 | CAATTTCTACTATCGGTAGAT |
| 1073 | CAATTTCTACTGCTGTAGAT |
| 1074 | CAATTTCTACCTCTTGTAGAT |
| 1075 | CAATTTCTACTGCGACGTAGAT |
| 1076 | GAATTTCTACTAGGCTGTAGAT |
| 1077 | AAATTTCTACTAAACGTAGAT |
| 1078 | GAATTTCTCCTAGGGTGGAGAT |
| 1079 | CAATTTCTACTCTACCGTAGAT |
| 1080 | CAATTTCTACTTTCGTAGAT |
| 1081 | CAATTTCTACTCTCAGGTAGAT |
| 1082 | CAATTTCTACTGCGCTGTAGAT |
| 1083 | GAATTTCTACTCACGGGTAGAT |
| 1084 | CAATTTCTACTTAGGCGTAGAT |
| 1085 | CAATTTCTACCAGTTGTAGAT |
| 1086 | GAATTTCTACTATCGGGTAGAT |
| 1087 | CAATTTCTACTCCCGTAGAT |
| 1088 | CAATTTCTACTACGCAGTAGAT |
| 1089 | CAATTTCTACTTCATGTAGAT |
| 1090 | CAATTTCTCCTATAGTGGAGAT |
| 1091 | CAATTTCTCCTAGCCTGGAGAT |
| 1092 | GAATTTCTACTCATCCGTAGAT |
| 1093 | CAATTTCTACTCCCAAGTAGAT |
| 1094 | CAATTTCTCCTATCGGGGAGAT |
| 1095 | CAATTATGCGTCTTTGTGTT |
| 1096 | CAATTTCTACTCGTCCGTAGAT |
| 1097 | CAATTTCTACTCCTCGTAGAT |
| 1098 | CAATTTCTACTCCATTGTAGAT |
| 1099 | CAATTTCTACTCACGTAGAT |
| 1100 | CAATTTCTACTTATTCGTAGAT |
| 1101 | CAATTTCTACTTCTGAGTAGAT |
| 1102 | CAATTTCTCCTTAGCGGAGAT |
| 1103 | CAATTTCTACTGTTTGTAGAT |
| 1104 | CAATTTCTACTTATAGTAGAT |
| 1105 | AAATTTCTACTGCGTCGTAGAT |
| 1106 | CAATTTCTCCTACTTGGAGAT |
| 1107 | GAATTTCTCCTCTCTGGAGAT |
| 1108 | CAATTTCTACTCGTAAGTAGAT |
| 1109 | GAATTTCTACTTGGCGGTAGAT |
| 1110 | CAATTTCTACTGCCTTGTAGAT |
| 1111 | AAATTTCTCCTACCTGGAGAT |
| 1112 | AAATTTCTACTGCAAGTAGAT |
| 1113 | CAATTTCTACTGGGACGTAGAT |
| 1114 | CAATTTCTACTACAACGTAGAT |
| 1115 | CAATTTCTACTGCAGTGTAGAT |

-continued

| | |
|---|---|
| 1116 | CAATTTCTACTCCATCGTAGAT |
| 1117 | CAATTTCTACTGAAGGTAGAT |
| 1118 | CAATTTCTACTGTAGAGTAGAT |
| 1119 | AAATTTCTACTCACACGTAGAT |
| 1120 | CAATTTCTACTAGTCGTAGAT |
| 1121 | CAATTTCTCCTAAGGCGGAGAT |
| 1122 | GAATTTCTACTGCTCGTAGAT |
| 1123 | GAATTTCTACCAGTTGTAGAT |
| 1124 | CAATTTCTCCTATCGTGGAGAT |
| 1125 | CAATTTCTACTCTCGGTAGAT |
| 1126 | CAATTTCTCCTAAGACGGAGAT |
| 1127 | GAATTTCTCCTCGGTGGAGAT |
| 1128 | CAATTTCTACTTATGCGTAGAT |
| 1129 | CAATTTTGCCTAAGTGGCGAT |
| 1130 | CAATTTCTACGCAAAAGTAGAT |
| 1131 | CAATTTCTACTTGAAGGTAGAT |
| 1132 | CAATTTCTACTTGGTGTAGAT |
| 1133 | GAATTTCTACTGGAAGTAGAT |
| 1134 | CAATTTCTACTACCTTGTAGAT |
| 1135 | GAATTTCTACACCCTAGTAGAT |
| 1136 | GAATTTCTCCTTGTCGGGAGAT |
| 1137 | CAATTGGAGGTAAGTCCTCCT |
| 1138 | AAATTTCTACGCCGTGGTAGAT |
| 1139 | AAATTTCTACTTACTGGTAGAT |
| 1140 | CAATTTCTCCTGTTTGGAGAT |
| 1141 | CAATTTCTCCTAGGCGGAGAT |
| 1142 | AAATTTCTACTGATGGGTAGAT |
| 1143 | CAATTCCTCCTCTTGGAGGT |
| 1144 | CAATTTCTCCTAGCGAGGAGAT |
| 1145 | AAATTTCTACTGGCCGTAGAT |
| 1146 | CAATTTATGATAAGTTCGTAT |
| 1147 | GAATTTCTCCTACGGCGGAGAT |
| 1148 | AAATTTCTCCTGACGTGGAGAT |
| 1149 | CAATTTCTACTGACAAGTAGAT |
| 1150 | CAATTTGTCTTCTTAGGTGT |

| SEQ ID NO: | gRNA Sequence |
|---|---|
| 1151 | AAATTGTGCGTAAGTTGCGTT |
| 1152 | GAATTTCTACTTCGCGTAGAT |
| 1153 | CAATTTCTACTGGTAAGTAGAT |
| 1154 | CAATTTCTACTTGCAGTAGAT |

-continued

| | |
|---|---|
| 1155 | CAATTTCTACTTGCAAGTAGAT |
| 1156 | CAATTTCTACTGGAACGTAGAT |
| 1157 | CAATTTCTACTCCTTGGTAGAT |
| 1158 | CAATTTCTACGCACCCGTAGAT |
| 1159 | CAATTTCTACTGGATTGTAGAT |
| 1160 | GAATTTCTACTTCTCGGTAGAT |
| 1161 | CAATTTCTACTGTACGTAGAT |
| 1162 | CAATTTCTACTCTACTGTAGAT |
| 1163 | GAATTTCTACTCCACAGTAGAT |
| 1164 | CAATTTCTACTGAGAGGTAGAT |
| 1165 | CAATTTCTACTATAGGTAGAT |
| 1166 | CAATTGTGTATCTTTATGCT |
| 1167 | CAATTTCTACTCGAGAGTAGAT |
| 1168 | CAATTTCTACTGGCAGTAGAT |
| 1169 | CAATTTCTACTTACCCGTAGAT |
| 1170 | AAATTTCTACTCAAGGGTAGAT |
| 1171 | CAATTTCTACTCAAGGGTAGAT |
| 1172 | CAATTTCTACTTCTAGGTAGAT |
| 1173 | CAATTTCTACCAATTGTAGAT |
| 1174 | CAATTTCTACTCTCATGTAGAT |
| 1175 | AAATTTCTACTCAATGGTAGAT |
| 1176 | CAATTTCTACTGTGACGTAGAT |
| 1177 | CAATTTCTCCTACTGAGGAGAT |
| 1178 | CAATTTCTACTAAGGTAGAT |
| 1179 | CAATTTCTACTGCAAGGTAGAT |
| 1180 | CAATTATTCGTCTTTGAATT |
| 1181 | CAATTTCTACTACTCCGTAGAT |
| 1182 | CAATTTCTCCTAAGCTGGAGAT |
| 1183 | CAATTTCTACTTGATCGTAGAT |
| 1184 | GAATTTCTACTCTGTCGTAGAT |
| 1185 | CAATTTCTACTCCAGCGTAGAT |
| 1186 | GAATTTCTACGTAGGCGTAGAT |
| 1187 | CAATTTCTACTTCGAGGTAGAT |
| 1188 | GAATTTCTACTTCGGTGTAGAT |
| 1189 | CAATTTCTACTCCCGCGTAGAT |
| 1190 | CAATTTCTACTACTTGGTAGAT |
| 1191 | AAATTGCGTGTAAGTTACGCT |
| 1192 | AAATTGCGACTAAGTGTTGCT |
| 1193 | GAATTTCTACTCTCTGTAGAT |
| 1194 | CAATTTGCATTCTTGTGCAT |
| 1195 | CAATTTCTACCAACGGTAGAT |

-continued

| | |
|---|---|
| 1196 | GAATTTCTACTACGTGGTAGAT |
| 1197 | CAATTTCTACTAGCGCGTAGAT |
| 1198 | CAATTTCTACTGTGCCGTAGAT |
| 1199 | AAATTTCTCCACTAGTGGAGAT |
| 1200 | GAATTTCTACGGCAAGTAGAT |
| 1201 | AAATTTCTACCCTGATGTAGAT |
| 1202 | AAATTTCTCCTCGGTGGAGAT |
| 1203 | GAATTTCTACTGTTGGGTAGAT |
| 1204 | CAATTTCTACTGAGTGTAGAT |
| 1205 | GAATTTCTACTTTTGTGTAGAT |
| 1206 | GAATTTCTCCTACATCGGAGAT |
| 1207 | CAATTCCTTATAAGTTGAGGT |
| 1208 | CAATTGGACGTAAGTTGTCTT |
| 1209 | GAATTTCTACTTCCCAGTAGAT |
| 1210 | CAATTTCTACTGACCGTAGAT |
| 1211 | CAATTTCTACTCGGAGTAGAT |
| 1212 | AAATTTCTACTGCGGTAGAT |
| 1213 | CAATTTCTCCTATTCTGGAGAT |
| 1214 | CAATTTCTACTCCGTGGTAGAT |
| 1215 | GAATTTCTACAATCCGTAGAT |
| 1216 | CAATTTCTACTTCTGTAGAT |
| 1217 | GAATTTCTACTCTGCGGTAGAT |
| 1218 | GAATTTCTCCTCCGTGGAGAT |
| 1219 | GAATTTCTCCTATGGGGAGAT |
| 1220 | CAATTAGTTGTAAGTCAGTTT |
| 1221 | GAATTTCTACTCCGATGTAGAT |
| 1222 | CAATTTCTACTCTGCGGTAGAT |
| 1223 | CAATTTCTACACGCTGTAGAT |
| 1224 | GAATTTCTACCTCCCGTAGAT |
| 1225 | AAATTTCTACTCGAGGGTAGAT |
| 1226 | GAATTGGCTTTAAGTAGGTCT |
| 1227 | CAATTGCTAGTCTTTTGGTT |
| 1228 | GAATTTCTACTGCGGAGTAGAT |
| 1229 | CAATTTCTACTCATCTGTAGAT |
| 1230 | CAATTTCTACTGCAGTAGAT |
| 1231 | GAATTTCTCCTATTTCGGAGAT |
| 1232 | GAATTTCTACTGCGGGGTAGAT |
| 1233 | CAATTTCTACTAAAGGGTAGAT |
| 1234 | CAATTTCTACTCTCCAGTAGAT |
| 1235 | GAATTTCTACCATTTCGGAGAT |
| 1236 | GAATTTCTCCTGCGAGGAGAT |
| 1237 | CAATTTCTACTACCGTAGAT |
| 1238 | CAATTTCTACTTCCATGTAGAT |
| 1239 | CAATTTCTACTTCCCCGTAGAT |
| 1240 | CAATTGACTGTAAGTTAGTTT |
| 1241 | AAATTTCTACGGAAATGTAGAT |
| 1242 | CAATTTCTACAACATGGTAGAT |
| 1243 | CAATTTCTACTGGAGTAGAT |
| 1244 | GAATTTCTCCTACGCTGGAGAT |
| 1245 | GAATTTCTACTACAAGTAGAT |
| 1246 | CAATTTCTACTCTAGGTAGAT |
| 1247 | GAATTTCTACTCATAGGTAGAT |
| 1248 | GAATTTCTACTGATAGGTAGAT |
| 1249 | CAATTTCTACCTCAGGTAGAT |
| 1250 | CAATTTCTACTCTAGCGTAGAT |
| 1251 | CAATTTCTACTCGAAGTAGAT |
| 1252 | AAATTTCTCCTACTGCGGAGAT |
| 1253 | CAATTTCTACTCTTAAGTAGAT |
| 1254 | CAATTTCTACTTTAGGGTAGAT |
| 1255 | CAATTTCTACTCCACGGTAGAT |
| 1256 | CAATTTCTACTGGTTGTAGAT |
| 1257 | CAATTTCTACTGACATGTAGAT |
| 1258 | CAATTTCTACTTTGAGTAGAT |
| 1259 | CAATTTCTACTTGAGTAGAT |
| 1260 | CAATTTCTCCTTTGAGGAGAT |
| 1261 | CAATTTCTACTCCGTTGTAGAT |
| 1262 | GAATTGGTGTAAGTTGCCAT |
| 1263 | CAATTTCTACTAGAGGTAGAT |
| 1264 | CAATTTCTACTGATAGGTAGAT |
| 1265 | CAATTTCTACTTCATCGTAGAT |
| 1266 | GAATTTCTACTGGTGTAGAT |
| 1267 | CAATTTCTACTGCCGGGTAGAT |
| 1268 | GAATTTCTACGCATTAGTAGAT |
| 1269 | CAATTTCTCCCAGCCGGGAGAT |
| 1270 | CAATTTCTACTCAATGGTAGAT |
| 1271 | CAATTTCTCCTAATTCGGAGAT |
| 1272 | CAATTTCTACTAGTATGTAGAT |
| 1273 | GAATTTCTACTCGCGCGTAGAT |
| 1274 | CAATTTCTACAGTAAGTAGAT |
| 1275 | CAATTTCTACTGAGCTGTAGAT |
| 1276 | AAATTTGACCTAAGTGGTCGT |

-continued

| | |
|---|---|
| 1277 | CAATTGTACTTAAGTAGTATT |
| 1278 | CAATTTCTACTAGCCCGTAGAT |
| 1279 | CAATTTCTACTCGCTCGTAGAT |
| 1280 | GAATTTCTACTGGATGTAGAT |
| 1281 | CAATTTCTACTCGGTGGTAGAT |
| 1282 | GAATTTGTCGTCTTCGACGT |
| 1283 | GAATTTCTACTCCCACGTAGAT |
| 1284 | GAATTTCTCCTAGCGCGGAGAT |
| 1285 | GAATTTCTACTGGTAGGTAGAT |
| 1286 | GAATTTCTACTAGTGCGTAGAT |
| 1287 | CAATTTCTACTCCTCAGTAGAT |
| 1288 | GAATTTCTACTCCATGTAGAT |
| 1289 | GAATTGCCTATAAGTTAGGCT |
| 1290 | CAATTTCTACTGGGCTGTAGAT |
| 1291 | CAATTAGTGATCTTTTGTTT |
| 1292 | CAATTTCTCCTATGCGGAGAT |
| 1293 | CAATTTTAGGTCTTCTTAGT |
| 1294 | CAATTTCTACTGGTGTGTAGAT |
| 263 | CAATTTGTGATCTTTCGTAT |
| 1295 | CAATTTCTACTCCTCGGTAGAT |
| 1296 | CAATTTCTACTCCTACGTAGAT |
| 1297 | CAATTTCTACTTTGTCGTAGAT |
| 1298 | GAATTTCTACTTGGTCGTAGAT |
| 1299 | GAATTTCTCCGTAAGAGGAGAT |
| 1300 | CAATTGTGCTTCTTAGTACT |
| 1301 | AAATTTCTACTCTGGCGTAGAT |
| 1302 | CAATTTCTCCTAGTGCGGAGAT |
| 1303 | GAATTTCTACTTAACCGTAGAT |
| 1304 | CAATTTCTACTGACGTGTAGAT |
| 1305 | CAATTGGGCGTCTTCGTCCT |
| 1306 | CAATTTCTACTCGTTGTAGAT |
| 1307 | CAATTTCTACCATTAGTAGAT |
| 1308 | CAATTTCTACCACTTGTAGAT |
| 1309 | CAATTTCTACTAGCGGTAGAT |
| 1310 | CAATTTCTACTATAACGTAGAT |
| 1311 | CAATTCCGCTTCTTAGTGGT |
| 1312 | CAATTTCTACTCGGACGTAGAT |
| 1313 | CAATTTCTACTATGAAGTAGAT |
| 1314 | CAATTTAAGCTCTTGTTTGT |
| 1315 | AAATTTCTCCCTTGCGGGAGAT |
| 1316 | GAATTTCTCCTCCTAGGAGAT |
| 1317 | GAATTTCTACAGTGGCGTAGAT |
| 1318 | CAATTTCTACTCCAGAGTAGAT |
| 1319 | GAATTTCTACTCGGTGGTAGAT |
| 1320 | CAATTTCTACTTCGTTGTAGAT |
| 1321 | CAATTTCTACTAACCAGTAGAT |
| 1322 | CAATTTCTACTCCCTGGTAGAT |
| 1323 | CAATTTCTCCTGAAGGGAGAT |
| 1324 | CAATTTCTACTACACGGTAGAT |
| 1325 | CAATTTCTACTCCTCTGTAGAT |
| 1326 | AAATTTCTACCGCAATGTAGAT |
| 1327 | CAATTTCTACTTCACTGTAGAT |
| 1328 | CAATTTCTACTTGCCGTAGAT |
| 1329 | CAATTTCTACTGTATTGTAGAT |
| 1330 | CAATTTCTACTCAGTGTAGAT |
| 1331 | CAATTTCTACTAATTAGTAGAT |
| 1332 | CAATTTCTACTTAGTCGTAGAT |
| 1333 | GAATTG CTCATCTTTGGGCT |
| 1334 | CAATTTCTACATAGGAGTAGAT |
| 1335 | GAATTTCTACAATAGGGTAGAT |
| 1336 | CAATTTCTACTACTGTGTAGAT |
| 1337 | GAATTTCTACTAAGCGGTAGAT |
| 1338 | CAATTTCTACTCACAGTAGAT |
| 1339 | AAATTTCTACTTTGAGGTAGAT |
| 1340 | CAATTTCTCCTACTGGGAGAT |
| 1341 | GAATTTCTACTGACCGTAGAT |
| 1342 | CAATTTCTACTTTAAGTAGAT |
| 1343 | CAATTTCTACTATTAGGTAGAT |
| 1344 | CAATTTCTACTAAAGTAGAT |
| 1345 | CAATTTCTACTTTGGTAGAT |
| 1346 | CAATTTCTACTAAAAGGTAGAT |
| 1347 | AAATTGCGCGTAAGTTGTGTT |
| 1348 | CAATTTCTACTTGTCAGTAGAT |
| 1349 | CAATTTCTACTGCCTCGTAGAT |
| 1350 | CAATTTCTACTAACAGGTAGAT |
| 1351 | CAATTTCTACTAGGTCGTAGAT |
| 1352 | CAATTTCTACTTCTCGGTAGAT |
| 1353 | CAATTTCTCCTAAGGGGAGAT |
| 1354 | GAATTTCTACCGATCGGTAGAT |
| 1355 | CAATTTCTCCTAGGTGGAGAT |
| 1356 | CAATTTCTACTCTAGAGTAGAT |

| | |
|---|---|
| 1357 | GAATTTCTACATACGTAGAT |
| 1358 | CAATTTCTACTCCCAGGTAGAT |
| 1359 | CAATTTCTACTGCCTGTAGAT |
| 1360 | GAATTTCTCCTACACTGGAGAT |
| 1361 | CAATTCTGTTTCTTAACAGT |
| 1362 | CAATTTCTACTTCGAGTAGAT |
| 1363 | CAATTTCTCCTACCTCGGAGAT |
| 1364 | CAATTGGTGCTAAGTGTGCTT |
| 1365 | CAATTTCTCCCGAAGGAGAT |
| 1366 | CAATTTCTACTGATGGGTAGAT |
| 1367 | CAATTTCTACTCGTACGTAGAT |
| 1368 | AAATTTCTACCAACATGTAGAT |
| 1369 | CAATTTCTACTGAGTCGTAGAT |
| 1370 | CAATTTCTACTACATCGTAGAT |
| 1371 | CAATTTCTACTTCCGAGTAGAT |
| 1372 | GAATTTCTACTCCCGTAGAT |
| 1373 | CAATTTCTACCAGTGGTAGAT |
| 1374 | CAATTTCTACTGCGCCGTAGAT |
| 1375 | GAATTTCTCCTTCAGGAGAT |
| 1376 | CAATTTCTACTTTATGTAGAT |
| 1377 | GAATTTCTACTCCGGTAGAT |
| 1378 | GAATTTCTACTCGCCGGTAGAT |
| 1379 | CAATTTCTACTGGGAGTAGAT |
| 1380 | GAATTTCTACACTCGAGTAGAT |
| 1381 | CAATTGGCAATCTTTTGCTT |
| 1382 | CAATTTCTACTAAGTTGTAGAT |
| 1383 | CAATTTCTCCTTCTGTGGAGAT |
| 1384 | CAATTTCTACTCTACGTAGAT |
| 1385 | GAATTTCTACTGCAGCGTAGAT |
| 1386 | AAATTTCTACCACGCGTAGAT |
| 1387 | AAATTTCTACCGCCTTGTAGAT |
| 1388 | GAATTTCTACGTCCGTGTAGAT |
| 1389 | GAATTTCTACTCTTGGTAGAT |
| 1390 | CAATTTCTACTTACGGTAGAT |
| 1391 | GAATTTCTACCATTGCGTAGAT |
| 1392 | GAATTTCTCCTACCATGGAGAT |
| 1393 | GAATTTCTACTGCAACGTAGAT |
| 1394 | CAATTTCTACTAAGGCGTAGAT |
| 1395 | CAATTTCTCCTATGTGGAGAT |
| 1396 | GAATTTCTACTTCAGCGTAGAT |
| 1397 | CAATTTCTACTTTTCGTAGAT |
| 1398 | CAATTTCGCCTAAGTGGCGAT |
| 1399 | CAATTTCTACTTGTATGTAGAT |
| 1400 | CAATTTCTACTATTCGTAGAT |
| 1401 | CAATTTCTACTGAGCCGTAGAT |
| 1402 | CAATTTCTCCTAAACTGGAGAT |
| 1403 | CAATTTCTCCAAGGCAGGAGAT |
| 1404 | AAATTTCTCCTACGTAGGAGAT |
| 1405 | CAATTTCTACTGCGAGTAGAT |
| 1406 | CAATTCCTAATAAGTTTAGGT |
| 1407 | GAATTCGTGTTCTTATGTGT |
| 1408 | AAATTTCTACGTTGCTGTAGAT |
| 1409 | CAATTTCTACCTCTCGTAGAT |
| 1410 | CAATTGAGTTTCTTAGTTCT |
| 1411 | CAATTTCTCCTAGCGGGAGAT |
| 1412 | CAATTTCTACTTTGAGGTAGAT |
| 1413 | GAATTTCTACTATTGAGTAGAT |
| 1414 | CAATTTCTACTTCAAGGTAGAT |
| 1415 | CAATTTCTACTGAGGAGTAGAT |
| 1416 | CAATTTCTACTGGAGGGTAGAT |
| 1417 | CAATTTCTACTTGGGTGTAGAT |
| 1418 | CAATTTCTACTGTTACGTAGAT |
| 1419 | AAATTTCTACCTCCAGTAGAT |
| 1420 | CAATTGGGACTAAGTGTTTTT |
| 1421 | CAATTTCTCCTTCGAGGAGAT |
| 1422 | CAATTTCTACTGGCCTGTAGAT |
| 1423 | CAATTTCTACGATTCAGTAGAT |
| 1424 | CAATTTCTACAATGCGTAGAT |
| 1425 | CAATTTCGCATCTTTGCGGT |
| 1426 | CAATTTCTCCGTCGTGGGAGAT |
| 1427 | CAATTTCTACTTTCCAGTAGAT |
| 1428 | CAATTTCTACTGATCCGTAGAT |
| 1429 | CAATTTCTACTACGGAGTAGAT |
| 1430 | AAATTTCTACCGCTTGTAGAT |
| 1431 | GAATTTCTACTGTGAGGTAGAT |
| 1432 | CAATTTCTCCTTTTGTGGAGAT |
| 1433 | GAATTTCTACTACGGTAGAT |
| 1434 | GAATTTCTACTGTGTCGTAGAT |
| 1435 | CAATTTCTCCTAGTTCGGAGAT |
| 1436 | CAATTTCTACTCCTGTGTAGAT |
| 1437 | GAATTTCTACTTGAACGTAGAT |

| | |
|---|---|
| 1438 | CAATTGATGATCTTTCATCT |
| 1439 | CAATTTCTACTGGTACGTAGAT |
| 1440 | AAATTTCTACTCATCCGTAGAT |
| 1441 | CAATTTCTGCTAAGTGCAGAT |
| 1442 | CAATTCAGGTTCTTATTTGT |
| 1443 | GAATTTCTACTACGCAGTAGAT |
| 1444 | GAATTGCGTTTCTTGGCGCT |
| 1445 | CAATTTCTCCTATTTTGGAGAT |
| 1446 | GAATTTCTACGCACAGGTAGAT |
| 1447 | CAATTTCTACTGAAGCGTAGAT |
| 1448 | GAATTTCTACTAACACGTAGAT |
| 1449 | CAATTAGGTATCTTTACCTT |
| 1450 | CAATTGGGTGTAAGTTGCCTT |
| 1451 | CAATTTCTACTGCAGGGTAGAT |
| 1452 | CAATTTCTACTCGCGCGTAGAT |
| 1453 | GAATTTCTACTGGATGGTAGAT |
| 1454 | CAATTCCATGTAAGTTATGGT |
| 1455 | CAATTTCTACTCCTGTAGAT |
| 1456 | CAATTTCTACTATTGTGTAGAT |
| 1457 | CAATTTCGGGTAAGTTTCGGT |
| 1458 | CAATTTCTACTTCAGTGTAGAT |
| 1459 | CAATTTCTACTCTGGGTAGAT |
| 1460 | CAATTTCTACTACTCAGTAGAT |
| 1461 | CAATTTCTACCTCATGTAGAT |
| 1462 | CAATTTCTACTGGTGAGTAGAT |
| 1463 | CAATTTCTACTGTCTGGTAGAT |
| 1464 | CAATTTCTACTCTGTGTAGAT |
| 1465 | CAATTTCTACTCAGTTGTAGAT |
| 1466 | CAATTTCCGTTCTTGCGGAT |
| 1467 | CAATTTCTACTGTAGCGTAGAT |
| 1468 | AAATTTCTACTCTACGTAGAT |
| 1469 | GAATTTCTCCTATATGGAGAT |
| 1470 | CAATTTCTACTGGCGGGTAGAT |
| 1471 | AAATTTCTACTCACCTGTAGAT |
| 1472 | CAATTTCTACTTTCGTGTAGAT |
| 1473 | CAATTTCTACTACAAGGTAGAT |
| 1474 | CAATTACGTGTCTTTGTGTT |
| 1475 | GAATTTCTACTCCAACGTAGAT |
| 1476 | GAATTTCTACTATGAGGTAGAT |
| 1477 | GAATTTCTCCTACGAGGAGAT |
| 1478 | CAATTGAGTTTCTTGATTCT |
| 1479 | CAATTTCTACTCTGGTAGAT |
| 1480 | CAATTTCTACAACCGCGTAGAT |
| 1481 | GAATTTCTACTTGTCGTAGAT |
| 1482 | CAATTGATTATAAGTTAGTCT |
| 80 | CAATTTCTCCTCTTGGAGAT |
| 1483 | CAATTTCTACTCTGACGTAGAT |
| 1484 | CAATTTCTACTGATTCGTAGAT |
| 1485 | CAATTTCTACTCGTTAGTAGAT |
| 1486 | CAATTCGGATTAAGTGTCCGT |
| 1487 | AAATTATGTGTCTTCACGTT |
| 1488 | GAATTTCTACTGTCCGGTAGAT |
| 1489 | GAATTTCTACTTTCCCGTAGAT |
| 1490 | CAATTGTTTGTCTTCGAACT |
| 1491 | AAATTTCTACATAATGTAGAT |
| 1492 | CAATTTCTCCTACTCGGAGAT |
| 1493 | CAATTTCTCCTAAAAGGAGAT |
| 1494 | GAATTTCTACTGACGCGTAGAT |
| 1495 | GAATTTCTACCATCAGTAGAT |
| 1496 | GAATTTCTACTCATTCGTAGAT |
| 1497 | CAATTTCTCCTAAGCGGAGAT |
| 1498 | CAATTTCTACTCTTAGTAGAT |
| 1499 | CAATTTCTCCTAACGTGGAGAT |
| 1500 | CAATTTCTACTCACTCGTAGAT |
| 1501 | GAATTTCTCCTGTCCTGGAGAT |
| 1502 | CAATTTCTACCAACATGTAGAT |
| 1503 | CAATTGTGTGTAAGTCGTGCT |
| 1504 | GAATTTCTACTCAATGTAGAT |
| 1505 | CAATTTCTACTACGGTAGAT |
| 1506 | GAATTTCTACTGAGGTAGAT |
| 1507 | GAATTGGGAGTCTTCTCCCT |
| 1508 | CAATTTCTCCTAGGCTGGAGAT |
| 1509 | CAATTAGTTTCTTGACTGT |
| 1510 | CAATTTCTCCTATTCGGAGAT |
| 1511 | AAATTTGACGTCTTCGTTGT |
| 1512 | CAATTTCTCCTATTGGGAGAT |
| 1513 | CAATTTCTACTTGACTGTAGAT |
| 1514 | GAATTTCTACTCGTTAGTAGAT |
| 1515 | CAATTTCTACTTTACGGTAGAT |
| 1516 | CAATTGTGTGTAAGTCACACT |
| 1517 | CAATTTCTACTTTCGGGTAGAT |

| | |
|---|---|
| 1518 | CAATTTCTACTAGCTCGTAGAT |
| 1519 | CAATTTCTACTTACTGTAGAT |
| 1520 | CAATTTCTACTCGCTGTAGAT |
| 1521 | CAATTGGATCTCTTGATCTT |
| 1522 | CAATTTCTACGGAAGTGTAGAT |
| 1523 | AAATTTCTCCTATTGGGAGAT |
| 1524 | CAATTTCTACTCAGCAGTAGAT |
| 1525 | CAATTTCTACTCATAGTAGAT |
| 1526 | CAATTTCTACAGACCTGTAGAT |
| 1527 | CAATTTCTACTGACGGTAGAT |
| 1528 | CAATTTCTACTGACCAGTAGAT |
| 1529 | CAATTTCTACTCGTGTAGAT |
| 1530 | CAATTTCTACTCAGAAGTAGAT |
| 1531 | CAATTTCTACTATCATGTAGAT |
| 1532 | CAATTTCTACCTAATCGTAGAT |
| 1533 | CAATTTCTACGAACCTGTAGAT |
| 1534 | GAATTTCTACTGCCCCGTAGAT |
| 1535 | CAATTTCTACTCAACAGTAGAT |
| 1536 | CAATTTCTCCTACGGGAGAT |
| 1537 | CAATTTCTACTGTTCGGTAGAT |
| 1538 | AAATTTCTCCTACAAGGAGAT |
| 1539 | GAATTTCTACTCTCCTGTAGAT |
| 1540 | CAATTTCTACTCTCGTGTAGAT |
| 1541 | GAATTTCTCCCCGAGGGAGAT |
| 1542 | CAATTTCTCCTCGGCGGAGAT |
| 1543 | GAATTTCTACTGCCCGGTAGAT |
| 1544 | GAATTTCTACTGCGCGGTAGAT |
| 1545 | CAATTGAGGTTAAGTGTTTCT |
| 1546 | CAATTTCTACTTCGTCGTAGAT |
| 1547 | CAATTAATTGTAAGTCGATTT |
| 1548 | AAATTTCTCCACGCAGGAGAT |
| 1549 | GAATTTCTACTCCTAGTAGAT |
| 1550 | CAATTTCTCCTACCCGGGAGAT |
| 1551 | GAATTTCTACCTACTGTAGAT |
| 1552 | CAATTTCTCCTACTTCGGAGAT |
| 1553 | CAATTTCTACTGACCCGTAGAT |
| 1554 | CAATTTCTACAGCAGAGTAGAT |
| 1555 | GAATTTCTACCACAGAGTAGAT |
| 1556 | CAATTTCTACCATGGCGTAGAT |
| 1557 | GAATTTCTACTATGGTAGAT |
| 1558 | GAATTCGACTTAAGTGGTCGT |
| 1559 | GAATTGCGGTTCTTGTCGCT |
| 1560 | CAATTTCTACTACAGAGTAGAT |
| 1561 | GAATTTCTCCTAGGGAGGAGAT |
| 1562 | GAATTGTCGTTCTTGTGGCT |
| 1563 | CAATTTCTACTTTATGGTAGAT |
| 1564 | CAATTGTGGTTCTTATTATT |
| 1565 | GAATTTCTACTAGCTGGTAGAT |
| 1566 | AAATTGGGCGTCTTCGTCTT |
| 1567 | CAATTTCTACTATCCTGTAGAT |
| 1568 | CAATTTCTACACTTCGTAGAT |
| 1569 | CAATTTCTACAATTGGGTAGAT |
| 1570 | CAATTTCTACTGAGGGTAGAT |
| 1571 | CAATTAGGTCTAAGTGGCCTT |
| 1572 | CAATTTCTACCAGGTGTAGAT |
| 1573 | GAATTTCTACAAAGCGGTAGAT |
| 1574 | CAATTCATGTTAAGTGCGTGT |
| 1575 | GAATTTCTACAAGTGTGTAGAT |
| 1576 | CAATTTCTACCTACAGTAGAT |
| 1577 | CAATTTCTCCGGAGAAGGAGAT |
| 1578 | CAATTTCTACTAGTTCGTAGAT |
| 1579 | GAATTACCTGTCTTCGGGTT |
| 1580 | CAATTATTTGTAAGTCGGATT |
| 1581 | GAATTTCTACTATAGCGTAGAT |
| 1582 | GAATTTCTCCTAACCTGGAGAT |
| 1583 | GAATTTCTACTACTCGGTAGAT |
| 1584 | CAATTTCTACTCACAGGTAGAT |
| 1585 | CAATTTCTACTATTGTAGAT |
| 1586 | CAATTTCTACTCTTCGGTAGAT |
| 1587 | CAATTTCTACTCACATGTAGAT |
| 1588 | CAATTTCTACTAAAAGTAGAT |
| 1589 | CAATTTCTACTCAGCCGTAGAT |
| 1590 | GAATTTCTCCTAATTGGAGAT |
| 1591 | CAATTTCTCCTATTAGGAGAT |
| 1592 | GAATTTCTACCCATCGTAGAT |
| 531 | CAATTGGTGTTAAGTGTACTT |
| 1593 | CAATTTCTACAACAGGTAGAT |
| 1594 | CAATTACGTCTCTTGACGTT |
| 1595 | CAATTTCTACCGCGGCGTAGAT |
| 1596 | GAATTTGCGATAAGTTTGTGT |
| 1597 | CAATTATTCGTAAGTTGAGTT |

| | |
|---|---|
| 1598 | CAATTTCTACATGGTGTAGAT |
| 1599 | GAATTTCTACCGCACGTAGAT |
| 1600 | CAATTTCTACTGGCTGTAGAT |
| 1601 | AAATTTCTCCTAAGTTGGAGAT |
| 1602 | CAATTGTACATCTTTGTATT |
| 1603 | CAATTTTCGTAAGTTGGGAT |
| 1604 | CAATTGGCTGTAAGTTGGCTT |
| 1605 | CAATTTCTACCGTTCGTAGAT |
| 1606 | CAATTGTGGATAAGTTTCGTT |
| 1607 | CAATTGTTGATAAGTTCAACT |
| 1608 | CAATTTCTACTCACAAGTAGAT |
| 1609 | CAATTTCTACCCAAGGTAGAT |
| 1610 | GAATTTCTCCATGAAGGGAGAT |
| 1611 | CAATTTCTACTCTAGTGTAGAT |
| 1612 | CAATTTTTGCTCTTGCAAAT |
| 1613 | CAATTAAGGCTCTTGCCTTT |
| 1614 | CAATTCTGTGTCTTTGTAGT |
| 1615 | CAATTTCTACTTATGTGTAGAT |
| 1616 | GAATTTCTCCACTCGGGAGAT |
| 1617 | CAATTTCTCCTGTTGGAGAT |
| 1618 | CAATTTCTACGATTTGGTAGAT |
| 1619 | CAATTTCTCCTTCGCGGAGAT |
| 1620 | AAATTTCTACCATCTTGTAGAT |
| 1621 | CAATTCCGCCTCTTGGCGGT |
| 1622 | CAATTTCTCCTAGGTTGGAGAT |
| 1623 | CAATTGTTTTTAAGTGAAGCT |
| 1624 | CAATTTCTACTGTCAGTAGAT |
| 1625 | CAATTTCTCCTACCAGGAGAT |
| 1626 | GAATTTCTACTTCCACGTAGAT |
| 1627 | GAATTTCTCCTTTGTGGAGAT |
| 1628 | CAATTTCTACTCATGTAGAT |
| 1629 | GAATTTCTACCCGGGCGTAGAT |
| 1630 | CAATTCGAACTAAGTGTTTGT |
| 1631 | CAATTTCTACTACCTAGTAGAT |
| 1632 | CAATTTCTACTGGCTCGTAGAT |
| 1633 | GAATTTCTACAAAGTTGTAGAT |
| 1634 | GAATTTCTACAGAGCAGTAGAT |
| 1635 | GAATTTCTACTGGCCGGTAGAT |
| 1636 | CAATTAGTGCTCTTGCGTTT |
| 1637 | GAATTTCTACTCCCGGTAGAT |
| 1638 | CAATTTCTACTAGAAAGTAGAT |
| 1639 | CAATTTCTACTGCAAGTAGAT |
| 1640 | CAATTTCTACGCTACGTAGAT |
| 1641 | CAATTTTCGATCTTTCGAGT |
| 1642 | GAATTTCTCCTTGTGTGGAGAT |
| 1643 | GAATTTCTACTTGTCTGTAGAT |
| 1644 | CAATTTCTACCATAAGTAGAT |
| 1645 | AAATTTCTCCTAAGAGGAGAT |
| 1646 | CAATTTCTACTGATGTAGAT |
| 1647 | CAATTTCTACATAATGGTAGAT |
| 1648 | CAATTTCTACTGCGCGGTAGAT |
| 1649 | GAATTTCTACCGTCCGTAGAT |
| 1650 | CAATTTCTACTACTAGTAGAT |
| 1651 | CAATTTCTACTACTTGTAGAT |
| 1652 | CAATTTCTACTGTACCGTAGAT |
| 1653 | CAATTTCTCCCGAAGTGGAGAT |
| 1654 | CAATTTTCAGTCTTCTGGAT |
| 1655 | AAATTTCTACTAAGTGTGGAT |
| 1656 | CAATTCTCCTTTCCGGAGAT |
| 1657 | CAATTGTTTATCTTTGGGCT |
| 1658 | GAATTTCTACACAACGTAGAT |
| 1659 | CAATTTAGTGTAAGTTGTTAT |
| 1660 | CAATTGCTAATCTTTTGGTT |
| 1661 | CAATTTCTACTGTCTAGTAGAT |
| 1662 | GAATTTCTACTATACGTAGAT |
| 1663 | CAATTTCTACGCCTAGGTAGAT |
| 1664 | CAATTTCTCCTTGTGCGGAGAT |
| 1665 | CAATTTCTACGCCGCGTAGAT |
| 1666 | CAATTTCTACGCCGTGTAGAT |
| 1667 | GAATTTCTACCCTGATGTAGAT |
| 1668 | CAATTTCTACTATGTCGTAGAT |
| 1669 | CAATTTCTACTTAGATGTAGAT |
| 1670 | CAATTTCTACTGCCGTAGAT |
| 1671 | CAATTGTTTATCTTTAGGCT |
| 1672 | CAATTGCCCATAAGTTGGGTT |
| 1673 | CAATTTTCGCTAAGTGCGGGT |
| 1674 | GAATTTCTACTCTGTGTAGAT |
| 1675 | CAATTTCTACTAGCCGTAGAT |
| 1676 | CAATTCCCGATCTTTCGGGT |
| 1677 | GAATTCGGTCTAAGTGGCCGT |
| 1678 | CAATTTCTACTGTAAGTAGAT |

-continued

| SEQ ID NO | gRNA Sequence |
|---|---|
| 1679 | CAATTTCTACTGTAGGTAGAT |
| 1680 | CAATTTCTACTTGTGTGTAGAT |
| 1681 | GAATTTCTCCTCGAATGGAGAT |
| 1682 | GAATTTCTACATGCCAGTAGAT |
| 1683 | CAATTTCTACCCTGTGGTAGAT |
| 1684 | CAATTTCTACTGCTCAGTAGAT |
| 1685 | AAATTTGCTGTAAGTCGGCGT |
| 1686 | CAATTTCTACTCCTGGTAGAT |
| 1687 | AAATTTCTACGCGTTGGTAGAT |
| 1688 | CAATTTCTACTCCCACGTAGAT |
| 1689 | CAATTCGCCTTCTTGGGCGT |
| 1690 | GAATTTCTACTCCCTAGTAGAT |
| 1691 | GAATTGCCGTTAAGTGCGGCT |
| 1692 | CAATTTTCCTTCTTAGGGGT |
| 1693 | CAATTCTGCGTCTTTGTGGT |
| 1694 | CAATTTCTACTAGGGAGTAGAT |
| 1695 | CAATTGGGTGTAAGTTATCTT |
| 1696 | CAATTTCTACTCTCCTGTAGAT |
| 1697 | GAATTGGTCTTCTTGGATCT |
| 1698 | CAATTTCTACTCGTTGGTAGAT |
| 1699 | CAATTTCTCCTTTGCGGAGAT |
| 1700 | CAATTTCTACTCCCCGGTAGAT |
| 1701 | CAATTGTAATTAAGTATTACT |
| 1702 | CAATTTCTACTCTTCCGTAGAT |
| 1703 | GAATTTGGCGTAAGTCGCCAT |
| 1704 | CAATTTCTACTCCAAGGTAGAT |
| 1705 | CAATTAGTCTTCTTGGATTT |
| 1706 | CAATTTCTACACTCGTGTAGAT |
| 1707 | GAATTTCTACTATGGCGTAGAT |
| 1708 | CAATTTCTCCTGGCATGGAGAT |
| 1709 | CAATTTCTCCACAACGGGAGAT |
| 1710 | CAATTTCTCCTCAAGCGGAGAT |
| 1711 | CAATTTCTCCTATAAGGAGAT |
| 1712 | CAATTTCTACTCGGGCGTAGAT |
| 1713 | CAATTGGCAGTAAGTTTGTCT |
| 1714 | CAATTTCTACTTATATGTAGAT |
| 1715 | CAATTTCTCCTTCCGTGGAGAT |
| 1716 | CAATTTCTACTCTCTCGTAGAT |
| 1717 | GAATTTCTCCACAGAAGGAGAT |
| 1718 | CAATTTCTACTGCAAAGTAGAT |
| 1719 | GAATTTCTCCTAGCGTGGAGAT |
| 1720 | CAATTTCTACTGCTGCGTAGAT |
| 1721 | CAATTTCTACTCGCAGTAGAT |
| 1722 | CAATTTCTACAGGTGGTAGAT |
| 1723 | CAATTTCTCCTATCCTGGAGAT |
| 1724 | CAATTTCTACTCGTGTGTAGAT |
| 1725 | CAATTTCTACTGAGGTAGAT |
| 1726 | GAATTTCTACCTCGTGTAGAT |
| 1727 | GAATTTCTACCCCTGGGTAGAT |
| 1728 | CAATTTCTACTTTTGGTAGAT |
| 1729 | GAATTGCTCGTCTTCGGGCT |

TABLE 4

WT_as provides identified gRNA sequences that bind AsCas12a (wild type) protein.

| SEQ ID NO | gRNA Sequence |
|---|---|
| 1730 | GAATTTCTACTGTACTGTAGAT |
| 1731 | AAATTTCTACTACCACGTAGAT |
| 1732 | GAATTTCTACTCTTGTAGAT |
| 1733 | CAATTTCTACTAGAAGTAGAT |
| 1734 | AAATTTCTACTCTCGTAGAT |
| 1735 | CAATTTCTACTAGAGTAGAT |
| 1736 | GAATTTCTACTACGGAGTAGAT |
| 1737 | GAATTTCTACTAGATCGTAGAT |
| 1738 | GAATTTTCGTTCTTACGGAT |
| 1739 | CAATTCACTGTAAGTTGGTGT |
| 77 | CAATTTCTACTCTTGTAGAT |
| 1740 | GAATTTCTACTAGTGTAGAT |
| 1741 | GAATTTCTACTTATACGTAGAT |
| 1742 | GAATTTCTACTTACAGTAGAT |
| 1743 | AAATTTCTCCATCCCGGAGAT |
| 1744 | CAATTAGTATTCTTATACTT |
| 1745 | CAATTTCTCCTATTGGAGAT |
| 1746 | GAATTTCTACTAATAAGTAGAT |
| 93 | AAATTCGATCTAAGTGATCGT |
| 1747 | GAATTAGTGGTCTTCCGCTT |
| 1748 | GAATTTCTACTTCCATGTAGAT |
| 1749 | GAATTTCTACTGTAGCGTAGAT |
| 1750 | AAATTGTCTGTCTTCAGGTT |
| 1751 | GAATTTCTACTTCCTGTAGAT |
| 1021 | CAATTTCTACTTTAGTAGAT |

TABLE 4-continued

WT_as provides identified gRNA sequences that bind AsCas12a (wild type) protein.

| | |
|---|---|
| 1752 | GAATTTCTACTGCTTCGTAGAT |
| 1753 | AAATTTCTACTGCCACGTAGAT |
| 1754 | GAATTTCTCCTATTGGAGAT |
| 1755 | CAATTATTTCTAAGTGGGGTT |
| 1756 | CAATTTCTACTTATCGTAGAT |
| 1757 | GAATTCTGTGTAAGTTGTGGT |
| 1758 | CAATTTCTACTACATGTAGAT |
| 666 | GAATTTCTACTCTCGTAGAT |
| 582 | GAATTTCTACTTTAGTAGAT |
| 80 | CAATTTCTCCTCTTGGAGAT |
| 677 | CAATTTCTACTCTAGTAGAT |
| 1759 | GAATTTCTACTGTAATGTAGAT |
| 1760 | CAATTTCTACTATCGTAGAT |
| 1585 | CAATTTCTACTATTGTAGAT |
| 1761 | GAATTTCTACTGGTACGTAGAT |
| 1762 | CAATTGAGACTAAGTGTTTTT |
| 1763 | AAATTTCTACTTGCAGTAGAT |
| 1345 | CAATTTCTACTTTGGTAGAT |
| 1455 | CAATTTCTACTCCTGTAGAT |
| 1764 | CAATTTCTACTAATGTAGAT |
| 1765 | GAATTTCTACTGACAGTAGAT |
| 684 | GAATTTCTACTACTGAGTAGAT |
| 674 | CAATTTCTACTGTGGTAGAT |
| 1766 | AAATTTCTACTAAAGTAGAT |
| 1767 | AAATTTCTACTGAATGTAGAT |
| 1768 | CAATTTCTACTGTAGTAGAT |
| 1769 | CAATTTCTCCTATCGGAGAT |
| 1770 | CAATTTCTACTCAAGTAGAT |
| 1546 | CAATTTCTACTTCGTCGTAGAT |
| 1771 | CAATTTCTACTAAACGTAGAT |
| 1772 | GAATTGTACCTAAGTGGTACT |
| 1773 | CAATTTCTACTTTCGTAGAT |
| 1774 | AAATTTCTCCTGTCGGAGAT |
| 1775 | CAATTTCTACTCATCCGTAGAT |
| 1776 | GAATTTCTACTGTTATGTAGAT |
| 1777 | CAATTTCTACTACTCCGTAGAT |
| 1778 | AAATTTCTACTAGTTGTAGAT |
| 1779 | CAATTTCTACTCCAAGTAGAT |
| 1780 | GAATTTCTACTGATCCGTAGAT |
| 1781 | CAATTTAGGATAAGTTTCTGT |
| 1782 | GAATTGTGTGTCTTTACACT |
| 1783 | CAATTGCAAGTAAGTTTTGCT |
| 1784 | CAATTTCTACTCTCGTAGAT |
| 1785 | GAATTTCTACTGATACGTAGAT |
| 1786 | GAATTTCTACTGAATCGTAGAT |
| 1787 | AAATTGGGCATCTTTGCTCT |
| 1788 | GAATTTCTACTTGCGTGTAGAT |
| 929 | CAATTTCTACTTCCACGTAGAT |
| 1789 | GAATTTCTACGTCAGCGTAGAT |
| 1790 | CAATTGAGGTTAAGTACCTTT |
| 1791 | GAATTTCTACTCTAGTAGAT |
| 1792 | AAATTTCTACTTGCATGTAGAT |
| 1793 | GAATTTCTACTACGTGTAGAT |
| 1794 | AAATTTCTCCTGCTAGGAGAT |
| 784 | CAATTTCTACTCTATCGTAGAT |
| 1795 | CAATTGGCTATCTTTGGCTT |
| 1796 | AAATTTCTACTTACTTGTAGAT |
| 1797 | GAATTTCTACTAACATGTAGAT |
| 1798 | GAATTTCTACTCCCAGTAGAT |
| 1799 | GAATTTCTACTGTGCGTAGAT |
| 1800 | CAATTTCTACTGTCTGTAGAT |
| 1801 | AAATTTCTACTCATACGTAGAT |
| 1802 | CAATTTCTACTTTTCCGTAGAT |
| 1803 | GAATTTCTACTACACTGTAGAT |
| 1273 | GAATTTCTACTCGCGCGTAGAT |
| 843 | CAATTTCTACTGAAGTGTAGAT |
| 1804 | GAATTTCTACTTGAGGTAGAT |
| 1481 | GAATTTCTACTTGTCGTAGAT |
| 1805 | GAATTGGGGGTAAGTCTTCCT |
| 1806 | CAATTTCTACTGTCGTAGAT |
| 1807 | CAATTTGCTGTCTTTGGCAT |
| 1808 | AAATTTCTACAGCCCCGTAGAT |
| 1809 | GAATTTCTACTAGCTGTAGAT |
| 1810 | CAATTTCTACAGTTAGTAGAT |
| 1811 | CAATTTCTACTAACTGTAGAT |
| 1812 | CAATTGGGTTTCTTGATCTT |
| 1813 | GAATTTCTCCTGGGGGAGAT |

TABLE 4-continued

WT_as provides identified gRNA sequences that bind AsCas12a (wild type) protein.

| | |
|---|---|
| 1814 | GAATTTCTACTGTATTGTAGAT |
| 1815 | GAATTTCTACTTGCGGTAGAT |
| 1529 | CAATTTCTACTCGTGTAGAT |
| 1816 | GAATTTCTACTAAAGTAGAT |
| 1817 | GAATTTCTCCGTGGCTGGAGAT |
| 964 | CAATTTCTACTGTTGTAGAT |
| 1818 | GAATTTCTCCTATCGGAGAT |
| 1819 | CAATTTCTACTTTCATGTAGAT |
| 1820 | AAATTTCTACTCGCGTAGAT |
| 1821 | CAATTTCTACAGAAAGTAGAT |
| 1822 | GAATTTCTCCCGTACAGGAGAT |
| 1823 | AAATTTCTACTGAGGTAGAT |
| 1824 | AAATTTCTACTCACGTAGAT |
| 1825 | CAATTCTTCCTCTTGGGAGT |
| 1826 | GAATTTCTACTCAAGTAGAT |
| 763 | CAATTTCTACTATGGTAGAT |
| 1827 | GAATTTCTCCGCCGAGGAGAT |
| 1828 | CAATTTCTACTAACCTGTAGAT |
| 1829 | CAATTTACGCTCTTGTGTGT |
| 598 | AAATTTCTACTAGGCGTAGAT |
| 1830 | AAATTTCTACTAGCGTAGAT |
| 1831 | AAATTTCTACTTATACGTAGAT |
| 1832 | CAATTTCTACCACAGTAGAT |
| 1833 | CAATTTCTCCTCTAGGAGAT |
| 1489 | GAATTTCTACTTTCCCGTAGAT |
| 848 | AAATTTCTCCTGTTGGAGAT |
| 1834 | CAATTTCTACTATATTGTAGAT |
| 1835 | GAATTTCTACTATTGCGTAGAT |
| 1836 | GAATTTCTACTTATCCGTAGAT |
| 1837 | CAATTGTGGGTCTTTTCATT |
| 1243 | CAATTTCTACTGGAGTAGAT |
| 1838 | AAATTTCTACTCTTTAGTAGAT |
| 1839 | GAATTTCTACTCAGCGTAGAT |
| 1840 | GAATTTCTCCGTCGATGGAGAT |
| 1841 | GAATTTCTCCCCGCTTGGAGAT |
| 1842 | CAATTTCTACTTATACGTAGAT |
| 1843 | AAATTTCTACTGTGTAGAT |
| 1844 | AAATTTCTACTTATGGTAGAT |
| 1845 | GAATTTCTACTAATACGTAGAT |
| 1846 | CAATTTCTACATAGTCGTAGAT |
| 1847 | CAATTTCTACTATCGCGTAGAT |
| 1848 | CAATTGGTTCTCTTGAATCT |
| 1849 | CAATTTCTCCCACGCTGGAGAT |
| 1850 | GAATTTCTACTATCTTGTAGAT |
| 1851 | CAATTTCTACTTCCTCGTAGAT |
| 1852 | CAATTTCTACTATAGTAGAT |
| 1376 | CAATTTCTACTTTATGTAGAT |
| 1853 | CAATTTCTACCGCACGTAGAT |
| 1854 | CAATTTCTCCTCTGGGAGAT |
| 1855 | CAATTGTGCGTAAGTCGCGCT |
| 1503 | CAATTGTGTGTAAGTCGTGCT |
| 1856 | CAATTTCTACACCCATGTAGAT |
| 1857 | CAATTGTCCTTCTTGGGGCT |
| 1858 | CAATTTCTACAACCTGTAGAT |
| 1859 | GAATTTCTACTGTTGTAGAT |
| 1860 | CAATTCTCCTGTAGGAGAT |
| 1861 | AAATTTCTACTCCCAGTAGAT |
| 1862 | CAATTCTCCCTACGGGAGAT |
| 1863 | GAATTTCTACCCTACTGTAGAT |
| 1864 | CAATTGGTGGTCTTCCGTCT |
| 1865 | AAATTTCTACCCGATCGTAGAT |
| 1866 | CAATTTCTCCTCTAGGGGAGAT |
| 1867 | AAATTTCTACTTTTGGTAGAT |
| 1868 | AAATTTCTACAGACCGTAGAT |
| 1869 | GAATTTCTACTGACGTAGAT |
| 1870 | AAATTTCTCCTCACGTGGAGAT |
| 1871 | CAATTTCTCCGTAGGGGGAGAT |
| 1872 | GAATTTCTACTTGACCGTAGAT |
| 1873 | GAATTTCTACTGGTAGTAGAT |
| 1874 | GAATTTCTACTATCCTGTAGAT |
| 1875 | CAATTTCTCCATCGTGGAGAT |
| 1876 | GAATTTCTACTGACACGTAGAT |
| 1877 | CAATTTCTACACGACGTAGAT |
| 1878 | AAATTTCTACTGGTTTGTAGAT |
| 1005 | CAATTTCTACTTAGGTAGAT |
| 1879 | AAATTTCTACTTCCACGTAGAT |
| 1880 | CAATTGCTGCTCTTGTGGTT |

TABLE 4-continued

WT_as provides identified gRNA sequences that bind AsCas12a (wild type) protein.

| | |
|---|---|
| 1881 | GAATTTCTACTCATGTAGAT |
| 1882 | AAATTTCTACTAGAATGTAGAT |
| 1883 | GAATTTCTACACAGCGTAGAT |
| 1884 | GAATTTCTACTATGCGTAGAT |
| 1885 | GAATTTCTACTAAGGGTAGAT |
| 1886 | CAATTATCGCTCTTGTGGTT |
| 1638 | CAATTTCTACTAGAAAGTAGAT |
| 1887 | CAATTGCCTGTAAGTTGGGCT |
| 1721 | CAATTTCTACTCGCAGTAGAT |
| 1888 | GAATTTCTACTGTCTCGTAGAT |
| 1889 | GAATTTCTCCCTCAAGGAGAT |
| 1890 | GAATTTGGCATCTTTGCCGT |
| 1891 | CAATTTCTACATAATGTAGAT |
| 1892 | GAATTTCTACTGTGGTGTAGAT |
| 1893 | GAATTTCTACTCTTTCGTAGAT |
| 1894 | GAATTTCTACTATTCGTAGAT |
| 1895 | AAATTTCTACTAATACGTAGAT |
| 1896 | GAATTCCTGTTCTTGCAGGT |
| 1400 | CAATTTCTACTATTCGTAGAT |
| 777 | GAATTTCTACTCCTGCGTAGAT |
| 1897 | CAATTTCTACCCACCTGTAGAT |
| 1898 | GAATTTCTACTTGCATGTAGAT |
| 1899 | GAATTTCTCCATGGCGGGAGAT |
| 1900 | CAATTGAGGCTAAGTGCCTCT |
| 1901 | AAATTTCTCCACAGCGGAGAT |
| 1902 | GAATTTCTACTGTCCCGTAGAT |
| 1903 | AAATTTCTACCCGTACGTAGAT |
| 1904 | CAATTTCTACTAACGAGTAGAT |
| 708 | CAATTTCTACTAATTGTAGAT |
| 1905 | CAATTCTGTTTAAGTGATAGT |
| 1906 | GAATTGTGTGTCTTTGTACT |
| 1907 | GAATTCGTGGTCTTCCGTGT |
| 1908 | GAATTTCTCCCGCCAGGAGAT |
| 1909 | AAATTTCTCCGCTGCTGGAGAT |
| 1910 | CAATTTCTCCCTCAGGGAGAT |
| 1911 | GAATTTCTACTGTCATGTAGAT |
| 1237 | CAATTTCTACTACCGTAGAT |
| 1912 | GAATTTCTACTGCCGTAGAT |
| 1166 | CAATTGTGTATCTTTATGCT |
| 1702 | CAATTTCTACTCTTCCGTAGAT |
| 1913 | GAATTTACCCTCTTGGGTGT |
| 1279 | CAATTTCTACTCGCTCGTAGAT |
| 1914 | GAATTTCTCCGACCCCGGAGAT |
| 1915 | GAATTTCTACCAAAAGGTAGAT |
| 1916 | AAATTTCTACTCTAGTAGAT |
| 1099 | CAATTTCTACTCACGTAGAT |
| 783 | CAATTTCTACTCCGGCGTAGAT |
| 1439 | CAATTTCTACTGGTACGTAGAT |
| 1917 | GAATTTCTACTTCTAGTAGAT |
| 1918 | AAATTCGTACTAAGTGTACGT |
| 1919 | GAATTGCGGATCTTTCTGTT |
| 1920 | CAATTTCTACTGGCCGTAGAT |
| 1921 | CAATTGTTCTCTTGAGCGT |
| 1922 | GAATTTCTACTCGTCGTAGAT |
| 1923 | GAATTTCTACCGAATAGTAGAT |
| 1924 | GAATTTCTACTATGGGTAGAT |
| 1925 | GAATTTCTACTTCGTTGTAGAT |
| 596 | GAATTTCTACTATCATGTAGAT |
| 1926 | GAATTTCTACTGCTCCGTAGAT |
| 1927 | GAATTGTCAGTCTTTTGGCT |
| 1928 | GAATTTCTCCTCGGCCGGAGAT |
| 1929 | GAATTTCTCCCCGGGAGGAGAT |
| 1534 | GAATTTCTACTGCCCCGTAGAT |
| 1930 | CAATTTCTACTTCCCGTAGAT |
| 1931 | CAATTTCTACCATCTGTAGAT |
| 1932 | AAATTTCTACTGGCACGTAGAT |
| 1933 | CAATTTCTACTGGTTCGTAGAT |
| 1934 | CAATTGAGTGTAAGTTACTCT |
| 1935 | CAATTTCTACTTTGTTGTAGAT |
| 1936 | CAATTAGTGGTCTTTCATTT |
| 1937 | AAATTTCTCCCCTCGCGGAGAT |
| 735 | GAATTTCTACTTTAACGTAGAT |
| 1938 | CAATTTCTACTTCCTGTAGAT |
| 1939 | GAATTTCTCCGAGTCGGAGAT |
| 1940 | CAATTTCTACTGGACGTAGAT |
| 1941 | GAATTTCTACTTGTTTGTAGAT |
| 1464 | CAATTTCTACTCTGTGTAGAT |

TABLE 4-continued

WT_as provides identified gRNA sequences that bind AsCas12a (wild type) protein.

| | |
|---|---|
| 1942 | GAATTTCTACTAGTTAGTAGAT |
| 1943 | GAATTTCTACTACGGCGTAGAT |
| 1944 | GAATTTCTCCATAGCGGGAGAT |
| 1945 | CAATTGCTTTTAAGTAAAGCT |
| 1946 | CAATTTCTCCTAACGGAGAT |
| 1947 | GAATTTTAGGTCTTCCTAGT |
| 1948 | CAATTTCTCCATAAGTGGAGAT |
| 1092 | GAATTTCTACTCATCCGTAGAT |
| 1949 | CAATTTCTACTAAGCCGTAGAT |
| 1189 | CAATTTCTACTCCCGCGTAGAT |
| 1950 | CAATTTCTACTGAACCGTAGAT |
| 1951 | AAATTTCTCCCATCGGGAGAT |
| 1952 | CAATTTGGGCTAAGTGTTCGT |
| 1953 | GAATTTCTCCGAACAGGAGAT |
| 1954 | GAATTTCTCCACGTCGGAGAT |
| 1955 | CAATTTCTCCAAGCACGGAGAT |
| 1956 | CAATTTCTCCGCACGGGAGAT |
| 1957 | CAATTTCTCCAAAGGAGGAGAT |
| 1114 | CAATTTCTACTACAACGTAGAT |
| 1958 | CAATTAGTGGTCTTCCGCTT |
| 1959 | AAATTTCTACTCATTCGTAGAT |
| 1960 | CAATTTCTACACACTGTAGAT |
| 1961 | GAATTTCTCCTATGGCGGAGAT |
| 1962 | GAATTTCTCCAACACGGAGAT |
| 1963 | CAATTCCTACTCTTGTGGGT |
| 1964 | AAATTTCTACTCGCTCGTAGAT |
| 1965 | AAATTTCTACTCAGAAGTAGAT |
| 1966 | GAATTTCTACTGGATAGTAGAT |
| 1967 | GAATTTCTACTCGCGTAGAT |
| 1968 | CAATTTCTACTAACTTGTAGAT |
| 1969 | GAATTTCTCCTCGTGGGAGAT |
| 1970 | CAATTTCTACTAATGCGTAGAT |
| 1971 | CAATTGTCCTTAAGTGGGCT |
| 1972 | CAATTTCTACTTCTGCGTAGAT |
| 1973 | GAATTTCTACGGTATAGTAGAT |
| 1479 | CAATTTCTACTCTGGTAGAT |
| 1974 | GAATTTCTACTACAATGTAGAT |
| 1975 | GAATTGTCTATCTTTGGACT |
| 1976 | GAATTTCTCCCTGCCCGGAGAT |
| 1977 | CAATTTCTACAGCTGGTAGAT |
| 1978 | AAATTTCTACTGACAGTAGAT |
| 875 | CAATTTCTACTCCACTGTAGAT |
| 1979 | CAATTTCTCCCACCGGAGAT |
| 1980 | CAATTAATCGTCTTCGATTT |
| 1981 | CAATTTCTACTGCTCCGTAGAT |
| 1982 | CAATTTCTCCAAGCCCGGAGAT |
| 1983 | CAATTTGTGCTAAGTGCGCGT |
| 1984 | AAATTTCTACTGCCTGTAGAT |
| 1985 | AAATTTCTCCAGCGGAGGAGAT |
| 1986 | GAATTTCTACTCCCCCGTAGAT |
| 1987 | GAATTTCTCCACCGTCGGAGAT |
| 1988 | AAATTTCTCCTGAAGGAGAT |
| 1989 | GAATTTCTACTTGGCCGTAGAT |
| 701 | AAATTTCTCCTATGGGAGAT |
| 1990 | CAATTTCTACCAGTAGTAGAT |
| 1991 | CAATTGGGACTCTTGTCCTT |
| 1992 | GAATTTCTACTTAAGTAGAT |
| 1993 | GAATTTCTACTTTGGTAGAT |
| 1994 | CAATTCAGCGTCTTTGTTGT |
| 1995 | CAATTGTTGATCTTTTGATT |
| 1996 | GAATTTCTACTAATGAGTAGAT |
| 1997 | AAATTTCTACTACCGGTAGAT |
| 1998 | AAATTTCTACTCAGCGTAGAT |
| 1999 | GAATTTCTACTTCCGGTAGAT |
| 2000 | AAATTTCTCCTGCTTCGGAGAT |
| 2001 | CAATTTCTCCCGGATGGAGAT |
| 2002 | GAATTTCTACTAGCGGTAGAT |
| 2003 | CAATTAGGGCTCTTGTCCTT |
| 2004 | AAATTTCTCCGCGAGGGAGAT |
| 2005 | CAATTTCTACTCTTACGTAGAT |
| 2006 | CAATTTCTCCCTCGCGGAGAT |
| 2007 | CAATTTCTCCGGTCACGGAGAT |
| 2008 | CAATTTCTCCGCAACGGGAGAT |
| 2009 | GAATTTCTCCGACGCGGAGAT |
| 2010 | CAATTACGGTTAAGTACCGTT |
| 2011 | CAATTTCTACCTAGTAGTAGAT |
| 2012 | CAATTTCTCCGCCGCGGAGAT |

TABLE 4-continued

WT_as provides identified gRNA sequences that bind AsCas12a (wild type) protein.

| SEQ ID NO: | gRNA sequence |
|---|---|
| 2013 | GAATTTCTACCAGACGGTAGAT |
| 2014 | CAATTTCTCCAACAAAGGAGAT |
| 2015 | CAATTTCTACTTAAGTAGAT |
| 2016 | AAATTTCTACGCGGAGTAGAT |
| 2017 | CAATTTCTACTATTTTGTAGAT |
| 2018 | GAATTTCTACCCCCCAGTAGAT |
| 2019 | GAATTTCTACTACACCGTAGAT |
| 2020 | GAATTTCTCCCCCCCCGGAGAT |
| 2021 | CAATTGAGTTTAAGTGGTTTT |
| 2022 | GAATTTCTCCGTCGTGGGAGAT |
| 2023 | CAATTTCTACTCTGCGTAGAT |
| 2024 | GAATTTCTACTCCAGGTAGAT |
| 2025 | CAATTTCTCCATCGGGGAGAT |
| 2026 | GAATTTCTCCTACTGGAGAT |
| 2027 | AAATTTCTACCAAGGAGTAGAT |
| 2028 | GAATTTCTACTGCACCGTAGAT |
| 2029 | CAATTTCTCCCTGGCTGGAGAT |
| 2030 | CAATTTTCGCTAAGTGCGGAT |

| SEQ ID NO: | gRNA sequence |
|---|---|
| 2031 | CAATTTCTACTATTGGTAGAT |
| 2032 | CAATTTCTACTACACCGTAGAT |
| 581 | GAATTTCTACTCGGCGTAGAT |
| 2033 | CAATTTCTCCCAAATGGGAGAT |
| 2034 | AAATTTCTCCCACTAGGAGAT |
| 2035 | CAATTTCTACTACATTGTAGAT |
| 2036 | GAATTTCTACTAGTAAGTAGAT |
| 2037 | CAATTTCTACTGCCCGTAGAT |
| 2038 | GAATTTCTACCAAATGTAGAT |
| 2039 | GAATTTCTACTGAGTCGTAGAT |
| 2040 | CAATTTCTACTGCGTCGTAGAT |
| 2041 | AAATTTCTACTCCCATGTAGAT |
| 2042 | GAATTTCTACAAGATAGTAGAT |
| 2043 | GAATTTCTCCCCCTGGAGAT |
| 2044 | CAATTTCTACGGCCGTAGAT |
| 2045 | CAATTTTTTGTCTTCAGGAT |
| 2046 | CAATTTCTACTCCCGGTAGAT |
| 2047 | CAATTTCTCCCAACGGAGAT |
| 2048 | CAATTTCTACTTTCTCGTAGAT |
| 2049 | CAATTTCTACGCCTGAGTAGAT |
| 2050 | CAATTGTGTATCTTTGTACT |
| 2051 | CAATTTCTACTAACGTGTAGAT |
| 2052 | AAATTTCTCCGCCGTGGAGAT |
| 2053 | AAATTTCTACTCCGTGTAGAT |
| 2054 | GAATTTCTACTCTGAAGTAGAT |
| 2055 | GAATTTCTCCTAATGGAGAT |
| 2056 | CAATTTCTACTAATTCGTAGAT |
| 2057 | GAATTTCTACTTGCGTAGAT |
| 2058 | CAATTTCTACCCCGAGTAGAT |
| 2059 | GAATTTCTACTTCCTCGTAGAT |
| 1161 | CAATTTCTACTGTACGTAGAT |
| 2060 | GAATTTCTACTTGTGGTAGAT |
| 1680 | CAATTTCTACTTGTGTGTAGAT |
| 2061 | GAATTTCTACTTGCCGGTAGAT |
| 2062 | GAATTTCTCCTAACGGAGAT |
| 2063 | CAATTTCTCCAGTGGGAGAT |
| 2064 | CAATTGCTCGTCTTTGAGTT |
| 2065 | CAATTGGCTATCTTTGGCCT |
| 2066 | CAATTTCTCCCGCTGGGAGAT |
| 2067 | CAATTTCTACTTGTACGTAGAT |
| 2068 | CAATTTCTACACTCTGTAGAT |
| 2069 | CAATTTCTACACGTCGTAGAT |
| 1152 | GAATTTCTACTTCGCGTAGAT |
| 1183 | CAATTTCTACTTGATCGTAGAT |
| 2070 | GAATTTCTCCTGTTGCGGAGAT |
| 2071 | CAATTTCTACTTGTCTGTAGAT |
| 584 | GAATTTCTACTTAGGTAGAT |
| 2072 | AAATTTCTCCCGCGTCGGAGAT |
| 2073 | GAATTTCTCCTGGAGGAGAT |
| 761 | CAATTTCTACTAAGAGTAGAT |
| 1447 | CAATTTCTACTGAAGCGTAGAT |
| 2074 | GAATTTCTACTCGATGTAGAT |
| 2075 | GAATTTCTACTGCATAGTAGAT |
| 2076 | GAATTTCTACTTCGAAGTAGAT |
| 2077 | GAATTTCTACTCGCAGTAGAT |
| 2078 | CAATTTCTCCGGAGCGGGAGAT |
| 2079 | CAATTTCTCCCACGATGGAGAT |
| 2080 | GAATTTCTCCCGCTCGGGAGAT |

TABLE 4-continued

WT_as provides identified gRNA sequences that bind AsCas12a (wild type) protein.

| | |
|---|---|
| 2081 | CAATTTAGCGTCTTTGTTGT |
| 2082 | CAATTGCGTGTCTTTGCGCT |
| 2083 | CAATTAACGCTCTTGCGTTT |
| 2084 | GAATTTCTACTAACTGGTAGAT |
| 2085 | CAATTTACCCTCTTGGGTGT |
| 2086 | CAATTTCTCCCGCCTGGAGAT |
| 1728 | CAATTTCTACTTTTGGTAGAT |
| 586 | GAATTTCTACTAGTGTGTAGAT |
| 2087 | GAATTTCTACTGGGAGTAGAT |
| 2088 | CAATTCTGAATCTTTTCGGT |
| 2089 | CAATTTCTCCCGCGCTGGAGAT |
| 2090 | CAATTTCTACATAGTGTAGAT |
| 2091 | CAATTTCTACTAGACCGTAGAT |
| 2092 | CAATTTCTACTCGACGTAGAT |
| 2093 | AAATTTCTACTTACTCGTAGAT |
| 2094 | GAATTTCTACCGTACGTAGAT |
| 2095 | GAATTTCTACTGCGCGTAGAT |
| 2096 | CAATTTCTCCACAAGGGAGAT |
| 2097 | GAATTTCTACGGTCGTAGAT |
| 2098 | CAATTACCGCTCTTGTGGTT |
| 1382 | CAATTTCTACTAAGTTGTAGAT |
| 2099 | CAATTCGTGTTCTTACATGT |
| 2100 | CAATTTCTACTTGTCCGTAGAT |
| 2101 | GAATTTCTACGGTCGCGTAGAT |
| 2102 | AAATTTCTACTGTGATGTAGAT |
| 2103 | CAATTTCTCCGTTAGCGGAGAT |
| 2104 | CAATTTCTACTTGTAGTAGAT |
| 2105 | GAATTTCTACTTTCGCGTAGAT |
| 2106 | GAATTTCTACTTCAGTGTAGAT |
| 2107 | AAATTTCTACTCAGATGTAGAT |
| 2108 | AAATTTCTCCCCTGGGAGAT |
| 2109 | CAATTTCTCCGCCCAGGAGAT |
| 2110 | AAATTTCTACCAGTTAGTAGAT |
| 2111 | CAATTCAGGTTCTTACCTGT |
| 2112 | CAATTTCTACGGGAGCGTAGAT |
| 2113 | GAATTTCTACTCTCACGTAGAT |
| 2114 | CAATTTCTACCTCCAAGTAGAT |
| 1305 | CAATTGGGCGTCTTCGTCCT |
| 2115 | CAATTCTTAGTCTTTTGGGT |
| 2116 | GAATTTCTCCGCGCGTGGAGAT |
| 2117 | CAATTCGGTTTAAGTGATTGT |
| 2118 | AAATTGGCTATCTTTGGCTT |
| 2119 | CAATTTCTCCAACGTGGAGAT |
| 2120 | GAATTTCTACTACGTTGTAGAT |
| 2121 | CAATTTCTACTGGCGTAGAT |
| 2122 | AAATTTCTACTTGTGTAGAT |
| 687 | AAATTTCTACCACTTGTAGAT |
| 2123 | GAATTTCTCCCGCAGCGGAGAT |
| 2124 | GAATTTCTCCCCCTGGGGAGAT |
| 2125 | CAATTTCTCCTGTACAGGAGAT |
| 2126 | GAATTTCTACTAGTCCGTAGAT |
| 2127 | AAATTTCTACTCACTGTAGAT |
| 2128 | AAATTTCTCCGATGACGGAGAT |
| 2129 | GAATTTCTACTATTTAGTAGAT |
| 805 | GAATTTCTACTATTGTAGAT |
| 2130 | CAATTTCTCCTGCTACGGAGAT |
| 2131 | CAATTTCTACGTCCGCGTAGAT |
| 2132 | CAATTTCTACTAGACTGTAGAT |
| 1020 | CAATTTCTACTGTGTGTAGAT |
| 2133 | CAATTTCTACTCTAATGTAGAT |
| 2134 | CAATTAGCAGTCTTCTGCTT |
| 2135 | CAATTTCTCCCAGTGAGGAGAT |
| 2136 | CAATTGCTCTTCTTAGGGCT |
| 1506 | GAATTTCTACTGAGGTAGAT |
| 1068 | CAATTTCTACTAGTAGTAGAT |
| 2137 | CAATTTCTACTCAGAGTAGAT |
| 2138 | CAATTTCTACTGTGAGTAGAT |
| 2139 | AAATTTCTACTCATGTAGAT |
| 2140 | CAATTTCTACCCTACGTAGAT |
| 2141 | CAATTGGTTGTCTTCGGCTT |
| 2142 | CAATTCTTGTTCTTGCGAGT |
| 2143 | GAATTTCTACTTTCGTAGAT |
| 2144 | GAATTTCTACTTCAGGTAGAT |
| 1026 | GAATTTCTACTTGGCGTAGAT |
| 2145 | GAATTTCTACTTTGACGTAGAT |
| 2146 | GAATTTCTCCACTTCGGGAGAT |
| 758 | CAATTTCTACTCACCGTAGAT |

TABLE 4-continued

WT_as provides identified gRNA sequences that bind AsCas12a (wild type) protein.

| | |
|---|---|
| 2147 | AAATTTCTACGAGCCGTAGAT |
| 2148 | AAATTGGTTGTCTTCGGCTT |
| 2149 | GAATTTCTACCCGCAGTAGAT |
| 2150 | CAATTTTGAATCTTTTCAGT |
| 2151 | GAATTTCTACTGCCTGTAGAT |
| 2152 | CAATTTCGCGTCTTCGTGGT |
| 998 | GAATTTCTACTGTCGTAGAT |
| 2153 | GAATTTCTACTTATCGTAGAT |
| 2154 | GAATTTGTTCTCTTGAGCGT |
| 2155 | GAATTTCTCCGAGAACGGAGAT |
| 2156 | CAATTTCTACCCTACGGTAGAT |
| 2157 | GAATTTCTCCTACGCCGGAGAT |
| 2158 | CAATTTCTACAGATTAGTAGAT |
| 789 | CAATTTCTACTAATGTGTAGAT |
| 2159 | CAATTTCTACTCCTGCGTAGAT |
| 2160 | GAATTTCTACCAATTAGTAGAT |
| 2161 | CAATTTCTCCTGCGGGGAGAT |
| 2162 | CAATTTCTACCTCTCTGTAGAT |
| 2163 | GAATTTCTACTTACTAGTAGAT |
| 2164 | CAATTTCTACCCCTGCGTAGAT |
| 2165 | CAATTTCTCCTCGAACGGAGAT |
| 2166 | CAATTTCTACGAAAGTGTAGAT |
| 2167 | CAATTAGTGCTCTTGCATTT |
| 2168 | AAATTTCTACCCACTCGTAGAT |
| 2169 | CAATTTCTCCATCCGAGGAGAT |
| 2170 | GAATTGCTGCTCTTGCGGCT |
| 741 | GAATTTCTACTCTTACGTAGAT |
| 2171 | CAATTTCTCCGTAACGGAGAT |
| 1105 | AAATTTCTACTGCGTCGTAGAT |
| 2172 | GAATTTCTCCCCACTTGGAGAT |
| 2173 | GAATTTCTACTGTGAGTAGAT |
| 2174 | CAATTTCTACTGCACGTAGAT |
| 2175 | CAATTAATGATCTTTCGTTT |
| 2176 | CAATTACTAGTAAGTCTGGTT |
| 2177 | CAATTTCTACCTGTGTAGAT |
| 2178 | CAATTACGTGTAAGTCGCGTT |
| 2179 | CAATTTCTCCTACCGGGAGAT |
| 2180 | CAATTTCTACACTCGCGTAGAT |
| 882 | CAATTTCTACTGAGTTGTAGAT |
| 2181 | GAATTTCTACTTGAGTAGAT |
| 2182 | GAATTTCTACTCAGCCGTAGAT |
| 2183 | CAATTTCTACTCCATGTAGAT |
| 2184 | CAATTTCTCCAGGAAGGAGAT |
| 2185 | CAATTGTTTGTAAGTCGAACT |
| 1178 | CAATTTCTACTAAGGTAGAT |
| 2186 | CAATTTCTACGGGAAGTAGAT |
| 2187 | CAATTTCTACAACGGTAGAT |
| 2188 | GAATTTCTCCGCGCCGGAGAT |
| 2189 | GAATTTCTACCCGACCGTAGAT |
| 1075 | CAATTTCTACTGCGACGTAGAT |
| 2190 | CAATTTCTACTGTTCGTAGAT |
| 2191 | CAATTTCTACTTAACGTAGAT |
| 2192 | GAATTTCTCCATATGGGAGAT |
| 2193 | GAATTTCTCCCTAGCGGGAGAT |
| 2194 | CAATTTCTACGACTCAGTAGAT |
| 2195 | CAATTTCTCCAGCATAGGAGAT |
| 2196 | GAATTTCTCCGCGAATGGAGAT |
| 2197 | GAATTTCTACGTCGCAGTAGAT |
| 1017 | CAATTTCTACTACTTCGTAGAT |
| 2198 | CAATTTCTACCAGCTAGTAGAT |
| 2199 | CAATTTCTACTGTTCTGTAGAT |
| 2200 | CAATTTCTCCTGAGTTGGAGAT |
| 2201 | GAATTTCTACGTACGAGTAGAT |
| 2202 | CAATTTAGGTTAAGTGCTTAT |
| 2203 | GAATTTCTACCAATAAGTAGAT |
| 2204 | AAATTTCTACCATCGTAGAT |
| 2205 | GAATTTCTCCTGAAGCGGAGAT |
| 2206 | GAATTTCTACAGGCGAGTAGAT |
| 2207 | CAATTTCTACTGGTCTGTAGAT |
| 2208 | CAATTTCTACTAAAGCGTAGAT |
| 2209 | CAATTTCTACCAGCGTGTAGAT |
| 2210 | CAATTGTGTTTAAGTGGCACT |
| 2211 | CAATTTCTCCTGCCAGGGAGAT |
| 2212 | GAATTTCTACTGCACGTAGAT |
| 2213 | AAATTTCTACTCGCAGTAGAT |
| 2214 | CAATTGTTAGTAAGTCTAGCT |
| 2215 | AAATTTCTACTGCGACGTAGAT |

TABLE 4-continued

WT_as provides identified gRNA sequences that bind AsCas12a (wild type) protein.

| | |
|---|---|
| 1649 | GAATTTCTACCGTCCGTAGAT |
| 2216 | GAATTTCTACTCACATGTAGAT |
| 2217 | CAATTTCTACCGGTGCGTAGAT |
| 2218 | GAATTTCTACGAGCTGGTAGAT |
| 2219 | CAATTTCTACTAACATGTAGAT |
| 2220 | GAATTTCTACTGGGGCGTAGAT |
| 942 | CAATTTCTACTACCACGTAGAT |
| 2221 | CAATTTATGGTCTTCTGTAT |
| 886 | CAATTTCTACTAGGAGTAGAT |
| 1341 | GAATTTCTACTGACCGTAGAT |
| 2222 | CAATTTCTCCCACCCTGGAGAT |
| 818 | CAATTTCTACTTCGGGTAGAT |
| 2223 | CAATTTCTCCCAGATCGGAGAT |
| 2224 | GAATTTCTCCCAGATGGAGAT |
| 2225 | CAATTTCTACTATCCCGTAGAT |
| 871 | AAATTTCTACTACAGGTAGAT |
| 2226 | GAATTTCTACTTCGATGTAGAT |
| 719 | GAATTTCTACTTGAGTGTAGAT |
| 2227 | CAATTTCTACTTAGCCGTAGAT |
| 1500 | CAATTTCTACTCACTCGTAGAT |
| 2228 | CAATTTCTCCTGTCGGAGAT |
| 2229 | CAATTTCTACAACAAAGTAGAT |
| 2230 | GAATTTCTACTCCCTCGTAGAT |
| 2231 | GAATTTCTACTCGCCTGTAGAT |
| 2232 | CAATTTTTGCTAAGTGTAGGT |
| 2233 | AAATTTCTCCGAACCAGGAGAT |
| 2234 | CAATTTCTCCCACAATGGAGAT |
| 2235 | CAATTCTGAATCTTTTCAGT |
| 2236 | CAATTTCTACTTGCCTGTAGAT |
| 2237 | CAATTGTGTGTCTTCGTACT |
| 2238 | AAATTTCTACTCACTCGTAGAT |
| 2239 | CAATTTCTACAATGTGTAGAT |
| 2240 | GAATTTCTCCGAACGAGGAGAT |
| 2241 | CAATTTCTACTCATTAGTAGAT |
| 1465 | CAATTTCTACTCAGTTGTAGAT |
| 2242 | CAATTTCTACAAGTGCGTAGAT |
| 2243 | CAATTGGCGTTAAGTACGTCT |
| 2244 | CAATTTCTACAGGTCGTAGAT |
| 2245 | GAATTTCTACTTGCACGTAGAT |
| 2246 | GAATTTCTACTGGCGCGTAGAT |
| 2247 | CAATTTCTACCTCCTCGTAGAT |
| 2248 | AAATTTCTCCCCCCGGGGAGAT |
| 2249 | CAATTTCTACCGATGTAGAT |
| 1700 | CAATTTCTACTCCCCGGTAGAT |
| 2250 | GAATTTCTACTGAGTGTAGAT |
| 2251 | GAATTTCTCCAAAGGGGGAGAT |
| 402 | GAATTCCTGCTCTTGTAGGT |
| 2252 | CAATTTCTACTTTATCGTAGAT |
| 2253 | CAATTTCTACGACTACGTAGAT |
| 2254 | CAATTTCTCCCCCAACGGAGAT |
| 2255 | GAATTTCTACAGGAGTAGAT |
| 2256 | CAATTTCTCCCCCTGGAGAT |
| 2257 | CAATTTCGTTTCTTGGCGGT |
| 2258 | CAATTTCTCCCTTTGGAGAT |
| 2259 | CAATTTCTACTTGCACGTAGAT |
| 1459 | CAATTTCTACTCTGGGTAGAT |
| 2260 | CAATTTCTACTTGGACGTAGAT |
| 2261 | AAATTTCTACAAGTCGTAGAT |
| 2262 | CAATTGTTGGTAAGTTTGATT |
| 2263 | CAATTTCTACTTCTTTGTAGAT |
| 2264 | GAATTTCTACTCATGTGTAGAT |
| 2265 | CAATTTCTCCTAGAGGAGAT |
| 2266 | GAATTTCTCCTGGCAAGGAGAT |
| 2267 | GAATTTCTACTCCATCGTAGAT |
| 2268 | AAATTTCTACCCCATGTAGAT |
| 2269 | CAATTTCTCCGGTCAAGGAGAT |
| 2270 | GAATTTCTCCCTCAGCGGAGAT |
| 2271 | GAATTTCTCCCTCGAAGGAGAT |
| 2272 | GAATTTCTACTACATGGTAGAT |
| 2273 | CAATTTCTACCAACGAGTAGAT |
| 2274 | GAATTTCTACTTTCAAGTAGAT |
| 1003 | GAATTTCTACTGCTTGTAGAT |
| 2275 | GAATTTCTACTGCCGCGTAGAT |
| 2276 | GAATTTCTACTAGTTGGTAGAT |
| 2277 | CAATTTCTACACATATGTAGAT |
| 2278 | CAATTTCTACCTGTCGTAGAT |
| 2279 | CAATTTGCGGTCTTTCGTGT |

TABLE 4-continued

WT_as provides identified gRNA sequences that bind AsCas12a (wild type) protein.

| SEQ ID NO | gRNA Sequence |
|---|---|
| 2280 | CAATTTCTACTAATTGTAGAT |
| 2281 | GAATTTCTACTAATGGTAGAT |
| 2282 | CAATTTCTACTTAAGCGTAGAT |
| 2283 | CAATTGGGATTCTTGTCCCT |
| 2284 | CAATTTCTACTTCTCCGTAGAT |
| 2285 | CAATTTCTCCCCCGACGGAGAT |
| 2286 | CAATTTCTCCTACTGGAGAT |
| 812 | CAATTTCTACTTTAGCGTAGAT |
| 2287 | CAATTTGTTCTCTTGGGTGT |
| 2288 | AAATTTCTCCGCTGACGGAGAT |
| 2289 | GAATTTCTACGACGTCGTAGAT |
| 1009 | CAATTTCTACTACATAGTAGAT |
| 1209 | GAATTTCTACTTCCCAGTAGAT |
| 2290 | CAATTGGAGGTCTTCTTTCT |
| 947 | CAATTTCTACTTTGACGTAGAT |
| 2291 | GAATTTCTACTTTTATGTAGAT |
| 2292 | CAATTTCTCCTGCACCGGAGAT |
| 2293 | GAATTTCTACCCTTATGTAGAT |
| 2294 | CAATTTCTACTATATCGTAGAT |
| 2295 | GAATTTCTACTCCACCGTAGAT |
| 2296 | CAATTTCTACTCATTGTAGAT |
| 2297 | CAATTGATGATCTTTTATTT |
| 2298 | CAATTTCTCCGTCGCCGGAGAT |
| 2299 | GAATTGTGGGTAAGTCCTATT |
| 786 | CAATTTCTACTAGTGTGTAGAT |
| 2300 | CAATTGTCTATCTTTGGACT |
| 2301 | CAATTTCTCCCTGTCGGAGAT |
| 2302 | GAATTCGTCCTCTTGGGCGT |
| 1351 | CAATTTCTACTAGGTCGTAGAT |
| 2303 | CAATTTCTACTAATGGTAGAT |
| 2304 | CAATTGGGGATCTTTTCCTT |
| 2305 | CAATTTCTACTGCTTGTAGAT |
| 2306 | CAATTTCTACAAAAGTAGAT |
| 2307 | GAATTTCTCCTGCACGGAGAT |
| 2308 | GAATTTCTACTCCATAGTAGAT |
| 1061 | CAATTTCTACTCGTTCGTAGAT |
| 2309 | CAATTTCTACCACTGGTAGAT |
| 2310 | CAATTTCTCCTCCTCTGGAGAT |
| 2311 | CAATTTCTCCTCTCGGAGAT |
| 2312 | GAATTTCTCCCAGCGGGAGAT |
| 1367 | CAATTTCTACTCGTACGTAGAT |
| 2313 | GAATTTCTACTAGGAGTAGAT |
| 2314 | CAATTTCTCCCTCAGCGGAGAT |
| 2315 | CAATTTCTCCCCTACCGGAGAT |
| 2316 | GAATTTCTACTCGTAAGTAGAT |
| 2317 | CAATTTATGGTAAGTCTATGT |
| 1165 | CAATTTCTACTATAGGTAGAT |
| 2318 | GAATTTCGCGTCTTCGTGGT |
| 2319 | GAATTTCTACTAATGTGTAGAT |
| 2320 | CAATTTCTCCCCTCTCGGAGAT |
| 2321 | CAATTTCTCCGGACTGGAGAT |
| 2322 | CAATTTCTACCTGGAAGTAGAT |
| 2323 | CAATTTCTCCCCGTTCGGAGAT |
| 2324 | CAATTGTTACTCTTGTGGTT |
| 2325 | CAATTTCTCCCCACCCGGAGAT |
| 2326 | AAATTGTGTTTAAGTGACACT |
| 2327 | CAATTTGGCTTCTTGGTTAT |
| 2328 | GAATTGGGCATCTTTGCTCT |
| 2329 | GAATTTCTACTTCGTGTAGAT |
| 2330 | GAATTGTGTTTAAGTGGCACT |
| 645 | CAATTTCTACTGGTGCGTAGAT |

TABLE 5

WT_1b provides identified gRNA sequences that bind LbCas12a protein.

| SEQ ID NO | gRNA Sequence | SEQ ID NO | gRNA Sequence |
|---|---|---|---|
| 575 | CAATTTCTACTAAGTGTAGAT | 2667 | CAATTTCTACTGTGCAGTAGAT |
| 2331 | AAATTTCTACTAGAGGGTAGAT | 796 | CAATTTCTACTATCCGTAGAT |
| 807 | GAATTTCTACTATCGAGTAGAT | 2668 | CAATTTCTACTCCCGTGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2332 | GAATTTCTACTTCCTTGTAGAT | 2669 | CAATTTCTACTTCGCGTAGAT |
| 1793 | GAATTTCTACTACGTGTAGAT | 2670 | CAATTTCTCCTACGCGGAGAT |
| 2333 | GAATTTCTACTAAGAGTAGAT | 1355 | CAATTTCTCCTAGGTGGAGAT |
| 1441 | CAATTTCTGCTAAGTGCAGAT | 906 | CAATTTCTACTGATTAGTAGAT |
| 648 | CAATTTCTACTATGCGTAGAT | 2671 | CAATTTCTACTAGCTGTAGAT |
| 650 | GAATTTCTACTAAGTGTAGAT | 2672 | GAATTTCTACCTACTTGTAGAT |
| 705 | GAATTTCTACTAGGTGTAGAT | 1611 | CAATTTCTACTCTAGTGTAGAT |
| 2334 | GAATTTCTACTATGAGTAGAT | 2673 | AAATTTCTACGTTACGGTAGAT |
| 704 | CAATTTCTACTATGTGTAGAT | 2674 | GAATTTCTACTGATTCGTAGAT |
| 1884 | GAATTTCTACTATGCGTAGAT | 1465 | CAATTTCTACTCAGTTGTAGAT |
| 2335 | GAATTTCTACTATGTGTAGAT | 2675 | CAATTTCTACTTGCCGGTAGAT |
| 673 | CAATTTCTACTATGAGTAGAT | 1040 | CAATTTCTACTGCTGTGTAGAT |
| 775 | GAATTTCTACTAAGCGTAGAT | 2676 | GAATTTCTCCTACGGGGAGAT |
| 2336 | AAATTTCTACTTGGCGTAGAT | 2677 | GAATTTCTACTTGGAGGTAGAT |
| 2337 | AAATTTCTACTAAGTGTAGAT | 2678 | GAATTTCTACTGCGGTGTAGAT |
| 2338 | GAATTTCTACTACGGGGTAGAT | 2679 | CAATTTCTAATAAGTTTAGAT |
| 1518 | CAATTTCTACTAGCTCGTAGAT | 2680 | AAATTTCTACACGAGTGTAGAT |
| 2339 | AAATTTCTACTATGGTAGAT | 2681 | CAATTCGTTGTAAGTTAACGT |
| 2340 | CAATTTCTACTAAGCGTAGAT | 1401 | CAATTTCTACTGAGCCGTAGAT |
| 2341 | GAATTTCTACTAACGAGTAGAT | 150 | CAATTGGGTGTCTTCATTCT |
| 731 | GAATTTCTACTACGAGTAGAT | 851 | CAATTTCTACTAGCGGGTAGAT |
| 2342 | CAATTTCTACTATTATGTAGAT | 1510 | CAATTTCTCCTATTCGGAGAT |
| 2343 | AAATTTCTACTAAAGTGTAGAT | 2682 | AAATTTCTACTGTTGAGTAGAT |
| 866 | CAATTTCTACTACGAGTAGAT | 2683 | CAATTTCTACTCGTATGTAGAT |
| 610 | CAATTTCTACTTCACGTAGAT | 2684 | CAATTTCTACTTCCTGGTAGAT |
| 2344 | AAATTTCTACTAGTAGTAGAT | 2685 | AAATTTCTACTACACGGTAGAT |
| 662 | CAATTTCTACTACGTGTAGAT | 2324 | CAATTGTTACTCTTGTGGTT |
| 1834 | CAATTTCTACTATATTGTAGAT | 2686 | CAATTTCTACTTAAGAGTAGAT |
| 620 | AAATTTCTACTAATGGGTAGAT | 2687 | CAATTATGTTTAAGTAACGTT |
| 2345 | GAATTTCTACTCTTCGTAGAT | 1397 | CAATTTCTACTTTTCGTAGAT |
| 2346 | AAATTTCTCCTACGGGGAGAT | 1026 | GAATTTCTACTTGGCGTAGAT |
| 2347 | AAATTTCTACTTTGTGTAGAT | 2688 | GAATTTCTCCTACAGCGGAGAT |
| 890 | CAATTTCTACTGGGTGTAGAT | 2689 | CAATTTCTACTGGCGGTAGAT |
| 2348 | AAATTTCTACTTCTGCGTAGAT | 2690 | GAATTTCTACTATGCGGTAGAT |
| 2349 | GAATTTCTACTCAGGGTAGAT | 2691 | CAATTTCTACTGGGATGTAGAT |
| 2350 | AAATTTCTACTATGTGTAGAT | 2692 | CAATTTCTACTCTCAAGTAGAT |
| 800 | CAATTTCTACTAGGTGTAGAT | 2019 | GAATTTCTACTACACCGTAGAT |
| 2351 | CAATTTCTACTGACGGGTAGAT | 2693 | CAATTACGGTTAAGTGTCGTT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2352 | AAATTTCTACTAAGGCGTAGAT | 2694 | CAATTTCTACTTACGTGTAGAT |
| 2041 | AAATTTCTACTCCCATGTAGAT | 2695 | CAATTGCTGGTAAGTCTAGCT |
| 718 | CAATTTCTACTACGCGTAGAT | 2696 | CAATTGGCGCTAAGTGCGCCT |
| 2353 | GAATTTCTACTCGTCCGTAGAT | 1041 | CAATTTCTACTACTGTAGAT |
| 2354 | AAATTTCTACTAACGTGTAGAT | 2163 | GAATTTCTACTTACTAGTAGAT |
| 909 | GAATTTCTACTGCAGAGTAGAT | 1247 | GAATTTCTACTCATAGGTAGAT |
| 1998 | AAATTTCTACTCAGCGTAGAT | 2697 | CAATTTCTACTTCTCAGTAGAT |
| 608 | CAATTTCTACTAGGCGTAGAT | 2698 | CAATTTCTACTAGTAAGTAGAT |
| 2355 | AAATTTCTACTTATCGTAGAT | 2699 | CAATTTCTACTAGCCTGTAGAT |
| 2356 | GAATTTCTACTCCCGGGTAGAT | 2700 | CAATTTCTCCGAATCGGGAGAT |
| 2357 | AAATTTCTACTAGGTGTAGAT | 2701 | GAATTTCTACTGGCGTAGAT |
| 956 | CAATTTCTACTTTGAAGTAGAT | 2702 | CAATTGTTCGTCTTCGAGTT |
| 1266 | GAATTTCTACTGGTGTAGAT | 2703 | CAATTTCTACTGGATGTAGAT |
| 1754 | GAATTTCTCCTATTGGAGAT | 2704 | CAATTTCTACTAAAGAGTAGAT |
| 2358 | GAATTTCTACTTAGCCGTAGAT | 2705 | GAATTGGTCATCTTTGGTCT |
| 2359 | CAATTTCTACTAGAGAGTAGAT | 2706 | CAATTTCTACTCCTTGTAGAT |
| 2360 | GAATTTCTACTACTTCGTAGAT | 2707 | GAATTTCTACTTGCTGTAGAT |
| 2361 | AAATTTCTCCTGGGTGGAGAT | 1230 | CAATTTCTACTGCAGTAGAT |
| 819 | AAATTTCTACTACGCGTAGAT | 2708 | GAATTTCTACTGCATGTAGAT |
| 2362 | AAATTTCTACTTCCAGGTAGAT | 2709 | CAATTTCTACTTCGCTGTAGAT |
| 2363 | AAATTTCTACTTCGGTGTAGAT | 2710 | CAATTTCTACTATGGCGTAGAT |
| 2364 | AAATTTCTACTGACCGTAGAT | 2711 | CAATTTCTACTCAGGAGTAGAT |
| 2365 | GAATTTCTACTAAGCAGTAGAT | 2712 | GAATTTCTACAACGGTGTAGAT |
| 2366 | GAATTTCTCCTAAGGGGAGAT | 2713 | CAATTCGCTGTCTTCAGCGT |
| 1943 | GAATTTCTACTACGGCGTAGAT | 2714 | GAATTTCTACTGTTACGTAGAT |
| 886 | CAATTTCTACTAGGAGTAGAT | 2305 | CAATTTCTACTGCTTGTAGAT |
| 2367 | CAATTTTAGTTAAGTATTAAT | 2715 | CAATTGTGCGTAAGTTGCGTT |
| 2368 | GAATTTCTACTATTTCGTAGAT | 2716 | CAATTGTTGATAAGTTTGACT |
| 598 | AAATTTCTACTAGGCGTAGAT | 1060 | GAATTTCTACTGGGCTGTAGAT |
| 2369 | GAATTTCTACTAAATTGTAGAT | 2717 | GAATTTCTACTCCTAAGTAGAT |
| 2313 | GAATTTCTACTAGGAGTAGAT | 2718 | CAATTTCTACATTTAGTAGAT |
| 1721 | CAATTTCTACTCGCAGTAGAT | 2719 | CAATTCGTCGTCTTCGACGT |
| 2370 | GAATTTCTACTCATTAGTAGAT | 2720 | CAATTGGTTATCTTTGATCT |
| 750 | CAATTTCTCCTAAGGGGAGAT | 1492 | CAATTTCTCCTACTCGGAGAT |
| 679 | AAATTTCTACTGGCAGTAGAT | 1838 | AAATTTCTACTCTTTAGTAGAT |
| 941 | GAATTTCTACTAAAGGGTAGAT | 2721 | GAATTTCTACTATGTTGTAGAT |
| 2371 | GAATTTCTACTGAAGTGTAGAT | 1525 | CAATTTCTACTCATAGTAGAT |
| 2372 | GAATTTCTACTCAAGTGTAGAT | 2722 | CAATTTCTACTTACAGGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2373 | AAATTTCTACTAAAGGGTAGAT | 2723 | CAATTCATCTTCTTAGGTGT |
| 2374 | AAATTTCTACTATTAGTAGAT | 1668 | CAATTTCTACTATGTCGTAGAT |
| 2375 | GAATTTCTACTCGGGGTAGAT | 2724 | GAATTTCTACTCCTGGTAGAT |
| 2376 | AAATTTCTACTTGCCGTAGAT | 2725 | CAATTTCTACTACAGGGTAGAT |
| 761 | CAATTTCTACTAAGAGTAGAT | 2726 | CAATTTCTCCGGTTAGGAGAT |
| 1252 | AAATTTCTCCTACTGCGGAGAT | 2727 | GAATTCGTCGTCTTTGATGT |
| 772 | CAATTTCTACTACGGGTAGAT | 2728 | CAATTTCTACTACCCTGTAGAT |
| 2377 | AAATTCTCGTTAAGTGTGGGT | 2729 | CAATTGGCGGTCTTCCGTCT |
| 2378 | GAATTTCTACTCTACGTAGAT | 2730 | GAATTTCTACTCGCTTGTAGAT |
| 854 | GAATTTCTACTGCAGTGTAGAT | 2731 | GAATTACTCGTCTTCGAGTT |
| 2379 | AAATTTCTCCTATAGCGGAGAT | 2732 | CAATTTCTACTAAGATGTAGAT |
| 2380 | AAATTCGTGGTCTTCCACGT | 2733 | CAATTTCTACTGTCTCGTAGAT |
| 794 | CAATTTCTACTAAAGGTAGAT | 885 | AAATTTCTACTATAAGGTAGAT |
| 2381 | AAATTTCTACTTCAAGTAGAT | 2734 | AAATTTCTACTTAAGCGTAGAT |
| 586 | GAATTTCTACTAGTGTGTAGAT | 2735 | CAATTTCTACTAGTCAGTAGAT |
| 603 | GAATTTCTACTACAGTGTAGAT | 2736 | CAATTGGTTCTCTTGGACTT |
| 896 | CAATTTCTACTATACTGTAGAT | 1080 | CAATTTCTACTTTCCGTAGAT |
| 2382 | CAATTTCTACTTAGTGTAGAT | 2737 | CAATTATACTTCTTAGTGTT |
| 1193 | GAATTTCTACTCTCTGTAGAT | 1414 | CAATTTCTACTTCAAGGTAGAT |
| 1847 | CAATTTCTACTATCGCGTAGAT | 2738 | CAATTTCTACTGTGCGTAGAT |
| 2028 | GAATTTCTACTGCACCGTAGAT | 1382 | CAATTTCTACTAAGTTGTAGAT |
| 2383 | GAATTTCTACTCCTTAGTAGAT | 2739 | GAATTTCTACTATGGTGTAGAT |
| 2384 | AAATTTCTACTGAAGTGTAGAT | 999 | CAATTTCTCCTATCAGGAGAT |
| 932 | CAATTTCTACTATCGTGTAGAT | 2740 | CAATTGCTTGTCTTTGGGCT |
| 1814 | GAATTTCTACTGTATTGTAGAT | 2741 | CAATTTCTACTAGCGTAGAT |
| 2385 | CAATTTCTACTTGGGAGTAGAT | 940 | GAATTTCTACTCAGTGTAGAT |
| 744 | AAATTTCTACTAAGCGTAGAT | 2742 | GAATTGGTGGTCTTTCGCCT |
| 1039 | CAATTTCTACTACAGTGTAGAT | 2743 | CAATTGGGGTTCTTATCTCT |
| 2386 | CAATTTCTACTCATATGTAGAT | 2744 | AAATTTCTACTAGGGGTAGAT |
| 2387 | AAATTTCTACTGTGTCGTAGAT | 2745 | CAATTTCTACTACGTTGTAGAT |
| 2388 | CAATTTCTACACGAATGTAGAT | 1090 | CAATTTCTCCTATAGTGGAGAT |
| 2389 | CAATTTCTCCTACTGTGGAGAT | 2746 | CAATTTCTACTCTTGAGTAGAT |
| 2390 | CAATTTCTACTAGTGAGTAGAT | 2747 | CAATTTCTACGTTGGTGTAGAT |
| 2391 | AAATTTCTACTTACGCGTAGAT | 2748 | GAATTTCTACTTCATGTAGAT |
| 2392 | GAATTTCTACCATCTGTAGAT | 1531 | CAATTTCTACTATCATGTAGAT |
| 1885 | GAATTTCTACTAAGGGTAGAT | 2749 | CAATTGTTTTTCTTGGAGTT |
| 786 | CAATTTCTACTAGTGTGTAGAT | 2750 | CAATTTCTACTTCAACGTAGAT |
| 2393 | GAATTTCTACTTTTGTAGAT | 2216 | GAATTTCTACTCACATGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2394 | GAATTTCTCCTATTTGGAGAT | 2751 | GAATTTCTACTCAATCGTAGAT |
| 2395 | CAATTTTTACTAAGTGTAGGT | 2752 | GAATTTCTACTACTCTGTAGAT |
| 1643 | GAATTTCTACTTGTCTGTAGAT | 1204 | CAATTTCTACTGAGTGTAGAT |
| 2396 | GAATTTCTACTAAACAGTAGAT | 1745 | CAATTTCTCCTATTGGAGAT |
| 2397 | GAATTTCTACTCTTCTGTAGAT | 1294 | CAATTTCTACTGGTGTGTAGAT |
| 1154 | CAATTTCTACTTGCAGTAGAT | 1949 | CAATTTCTACTAAGCCGTAGAT |
| 2398 | AAATTTCTACTAGTCGTAGAT | 2753 | GAATTTCTACTAGAGTGTAGAT |
| 2399 | GAATTTCTACTTACCTGTAGAT | 2754 | AAATTTCTCCCCGAGCGGAGAT |
| 2400 | CAATTGGGTTTCTTGACCCT | 743 | CAATTTCTACTAAGGAGTAGAT |
| 2401 | AAATTTCTCCTAAGTGGAGAT | 1280 | GAATTTCTACTGGATGTAGAT |
| 2051 | CAATTTCTACTAACGTGTAGAT | 2755 | GAATTTCTCCTGGGCGGAGAT |
| 2220 | GAATTTCTACTGGGGCGTAGAT | 2756 | GAATTACGCTTAAGTGGCGTT |
| 2402 | GAATTTCTCCTACGTGGAGAT | 2757 | CAATTTCTACTTCGGCGTAGAT |
| 971 | GAATTTCTACTTCCCTGTAGAT | 2758 | CAATTTCTACTTATGGGTAGAT |
| 2403 | GAATTTCTACTACGGGTAGAT | 2759 | CAATTTCTACTGTCCGTAGAT |
| 619 | GAATTTCTACTAGCGAGTAGAT | 2760 | CAATTGGGTTTCTTGGCTTT |
| 976 | CAATTTCTCCTAAGTGGAGAT | 1062 | GAATTTCTACTACCCGTAGAT |
| 2404 | GAATTTCTACTAGGATGTAGAT | 1297 | CAATTTCTACTTTGTCGTAGAT |
| 1585 | CAATTTCTACTATTGTAGAT | 2761 | CAATTGGTGTTCTTGTATTT |
| 2405 | AAATTGGTGTTCTTGTGCTT | 2762 | CAATTTCTACTCCAGTAGAT |
| 664 | CAATTTCTACTATGGGTAGAT | 2763 | CAATTACGTTTAAGTGGCGTT |
| 2406 | GAATTTCTACTATATCGTAGAT | 2764 | AAATTTCTACTTCGCGTAGAT |
| 2407 | CAATTTCTACTTCCAAGTAGAT | 2765 | CAATTTCTACTTACCTGTAGAT |
| 2408 | AAATTTCTACTGGGCCGTAGAT | 2190 | CAATTTCTACTGTTCGTAGAT |
| 2409 | CAATTTCTCCTAGCTGGAGAT | 666 | GAATTTCTACTCTCGTAGAT |
| 1456 | CAATTTCTACTATTGTGTAGAT | 2766 | CAATTTCTACTGCTCGTAGAT |
| 2410 | GAATTTCTACTGCGAGTAGAT | 2767 | CAATTTCTACTTACGGGTAGAT |
| 2411 | CAATTTCTCGTAAGTCGAGAT | 2768 | CAATTTCTACTTTCGAGTAGAT |
| 2412 | GAATTTCTACTCGCGTGTAGAT | 2769 | CAATTGGTATTCTTGTACCT |
| 2413 | CAATTTCTACTCAAACGTAGAT | 2770 | CAATTCACGTTCTTATGTGT |
| 2414 | AAATTTCTACTATTTGTAGAT | 2771 | GAATTCCCTCTCTTGGGGGT |
| 740 | CAATTTCTACTATTGAGTAGAT | 2772 | CAATTTCTACTAACCGTAGAT |
| 2415 | GAATTTCTACTGCTTAGTAGAT | 2773 | CAATTTCTCCCTCTACGGAGAT |
| 2416 | CAATTTCTACTAGAGTGTAGAT | 2774 | GAATTTCTCCCGTCTGGGAGAT |
| 2417 | AAATTTCTACTTACGAGTAGAT | 2775 | GAATTTCTACAGCCCGGTAGAT |
| 1434 | GAATTTCTACTGTGTCGTAGAT | 2776 | GAATTTCTACTAATGGGTAGAT |
| 2418 | GAATTTCTACTACAGCGTAGAT | 2777 | GAATTTCTACTTCGGTAGAT |
| 1799 | GAATTTCTACTGTGCGTAGAT | 2778 | CAATTTCTACTGGGCAGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 1968 | CAATTTCTACTAACTTGTAGAT | 2779 | CAATTACTCCTAAGTGGGGTT |
| 2419 | GAATTTCTACTTCGAGTAGAT | 1329 | CAATTTCTACTGTATTGTAGAT |
| 2420 | AAATTTCTACTCGGTGTAGAT | 985 | GAATTTCTACTTGGTGTAGAT |
| 2421 | AAATTTCTACTCTAAGTAGAT | 2780 | CAATTTCTACTGTTCAGTAGAT |
| 2422 | CAATTTCTACTCGGTTGTAGAT | 2781 | CAATTGCGTGTCTTTGTGCT |
| 2423 | GAATTTCTACTCATGGTAGAT | 2782 | GAATTTCTACCGGTCGGTAGAT |
| 2424 | AAATTTCTACTAACGCGTAGAT | 2783 | CAATTGGTTCTAAGTGGGTTT |
| 2425 | GAATTTCTACTCCAGAGTAGAT | 2159 | CAATTTCTACTCCTGCGTAGAT |
| 2426 | GAATTTCTACTAGCTTGTAGAT | 2059 | GAATTTCTACTTCCTCGTAGAT |
| 2427 | CAATTTCTACTTCAAGTAGAT | 645 | CAATTTCTACTGGTGCGTAGAT |
| 2428 | AAATTTCTACTCCATCGTAGAT | 2784 | AAATTTCTACCTGTCGTAGAT |
| 2429 | GAATTTCTGCTAAGTGCAGAT | 2785 | CAATTTCTACTACCGGTAGAT |
| 2430 | GAATTTCTACTAGCGTGTAGAT | 2786 | CAATTTCTACTCGTCGTAGAT |
| 2431 | AAATTTCTACTCCGGCGTAGAT | 778 | CAATTTCTACTAGGTGGTAGAT |
| 2432 | CAATTTCTACTAGCGAGTAGAT | 2286 | CAATTTCTCCTACTGGAGAT |
| 2433 | GAATTTCTACTGATGGGTAGAT | 2787 | CAATTTATCTTCTTGGATAT |
| 2434 | GAATTTCTACTTTGTTGTAGAT | 2788 | CAATTCCGACTAAGTGTCGGT |
| 2435 | CAATTTCTACTATCGGGTAGAT | 2789 | GAATTTCTACTCGTGGTAGAT |
| 700 | GAATTTCTACTGCCGTGTAGAT | 2790 | AAATTTCTCCTAAATGGAGAT |
| 2436 | AAATTTCTACTACTCGTAGAT | 2791 | CAATTATTATTAAGTGTGGTT |
| 634 | CAATTTCTACTGGAGCGTAGAT | 2792 | GAATTCCAGGTCTTCCTGGT |
| 1389 | GAATTTCTACTCTTGGTAGAT | 2793 | GAATTTCTACCTGTTGGTAGAT |
| 1310 | CAATTTCTACTATAACGTAGAT | 85 | CAATTCCTACTCTTGTAGGT |
| 882 | CAATTTCTACTGAGTTGTAGAT | 1631 | CAATTTCTACTACCTAGTAGAT |
| 712 | GAATTTCTACTGTTGAGTAGAT | 2794 | CAATTTCTACTGTTCCGTAGAT |
| 2437 | GAATTTCTACTAGAACGTAGAT | 386 | CAATTACGGGTCTTCCTGTT |
| 1736 | GAATTTCTACTACGGAGTAGAT | 2795 | CAATTACCATTAAGTATGGTT |
| 2438 | GAATTTCTACTACCGTAGAT | 2796 | CAATTTCTACTTGCGGTAGAT |
| 2439 | CAATTTCTACTAGCAGTAGAT | 2797 | GAATTTCTACTGTCGGTAGAT |
| 2440 | GAATTTCTACTGTCCGTAGAT | 779 | CAATTTCTCCTACATGGAGAT |
| 2441 | CAATTTTTACTAAGTGTAAAT | 2798 | CAATTTCTACTTGGATGTAGAT |
| 597 | GAATTTCTACTAACGTGTAGAT | 2799 | GAATTTCTACTAGTTTGTAGAT |
| 2442 | GAATTTCTACTGTAAGTAGAT | 2800 | CAATTTCTACTGGGCGTAGAT |
| 789 | CAATTTCTACTAATGTGTAGAT | 2801 | GAATTCGAGCTAAGTGTTTGT |
| 1197 | CAATTTCTACTAGCGCGTAGAT | 2802 | GAATTTCGCCTAAGTGGCGAT |
| 2443 | GAATTTCTACTCACGAGTAGAT | 2803 | GAATTGCGTCTAAGTGGTGTT |
| 2444 | GAATTTCTACTCAAGCGTAGAT | 1418 | CAATTTCTACTGTTACGTAGAT |
| 2445 | GAATTTCTACAGGTTGGTAGAT | 2804 | CAATTTCTACTTAGAGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2446 | GAATTTCTACTGACCAGTAGAT | 2805 | CAATTTCTCCTGAGTGGAGAT |
| 2447 | GAATTTCTACTTCCGGGTAGAT | 2806 | AAATTTCTACTCTAGCGTAGAT |
| 2448 | CAATTTCTACTACTCGTAGAT | 1071 | CAATTTCTACTACACGTAGAT |
| 1588 | CAATTTCTACTAAAAGTAGAT | 2807 | CAATTTCTACTGGAGAGTAGAT |
| 1893 | GAATTTCTACTCTTTCGTAGAT | 810 | CAATTCCTCCTAAGTGGAGGT |
| 2449 | GAATTGGTTATCTTTGATCT | 1155 | CAATTTCTACTTGCAAGTAGAT |
| 822 | GAATTTCTACTGTTTTGTAGAT | 2808 | AAATTCGTCGTCTTCGGCGT |
| 2208 | CAATTTCTACTAAAGCGTAGAT | 2809 | CAATTTCTCCTAGGGGAGAT |
| 2450 | GAATTTCTACTTCGGCGTAGAT | 2810 | GAATTTCTACTCCCTTGTAGAT |
| 2451 | GAATTTAGGTTAAGTGTTTAT | 2811 | CAATTGGTTCTCTTGGGCTT |
| 1876 | GAATTTCTACTGACACGTAGAT | 2812 | CAATTCCGCATCTTTGCGGT |
| 2452 | CAATTTCTACTTAATGTAGAT | 2813 | CAATTTCTACATGCTGTAGAT |
| 1916 | AAATTTCTACTCTAGTAGAT | 2814 | CAATTGTTCTTAAGTAGAACT |
| 2453 | AAATTTCTACTCGTGCGTAGAT | 2815 | CAATTTTGCATCTTTGTGAT |
| 1714 | CAATTTCTACTTATATGTAGAT | 2132 | CAATTTCTACTAGACTGTAGAT |
| 2454 | CAATTTCTCCTATGGGAGAT | 1429 | CAATTTCTACTACGGAGTAGAT |
| 1072 | CAATTTCTACTATCGGTAGAT | 2816 | CAATTTCTCCTCATAAGGAGAT |
| 623 | AAATTTCTACTCCTGTAGAT | 2054 | GAATTTCTACTCTGAAGTAGAT |
| 2455 | CAATTTCTACTTTGTGTAGAT | 2817 | CAATTTCTACTACCCGTAGAT |
| 2456 | CAATTTCTACTAAATAGTAGAT | 1455 | CAATTTCTACTCCTGTAGAT |
| 2457 | AAATTTCTACTCCCGTAGAT | 2818 | GAATTCGCATTAAGTGTGTGT |
| 2458 | CAATTTCTACTAACAAGTAGAT | 1779 | CAATTTCTACTCCAAGTAGAT |
| 2459 | GAATTTCTACTACCAAGTAGAT | 2819 | AAATTCGTGTTCTTACGCGT |
| 1581 | GAATTTCTACTATAGCGTAGAT | 1488 | GAATTTCTACTGTCCGGTAGAT |
| 1970 | CAATTTCTACTAATGCGTAGAT | 2820 | CAATTTCTACTCGAGCGTAGAT |
| 2460 | AAATTTCTACTCCACGTAGAT | 2821 | CAATTACGACTAAGTGTTGTT |
| 2461 | GAATTTCTACTGTTCAGTAGAT | 2822 | CAATTTCTCCTATGGAGGAGAT |
| 2462 | CAATTTCTACTTTGGAGTAGAT | 1133 | GAATTTCTACTGGAAGTAGAT |
| 746 | CAATTTCTACTGTGGTGTAGAT | 2823 | CAATTTAACGTAAGTCGTTGT |
| 735 | GAATTTCTACTTTAACGTAGAT | 2824 | GAATTTCTACATTCCAGTAGAT |
| 2463 | GAATTTCTACTGATTGTAGAT | 2825 | CAATTTCTACTACGACGTAGAT |
| 902 | CAATTTCTACTTGGCGTAGAT | 2826 | CAATTTCTACTCAGACGTAGAT |
| 2464 | AAATTTCTACTACACAGTAGAT | 2827 | GAATTTCTACTCTACTGTAGAT |
| 986 | CAATTTCTACTATTCGGTAGAT | 2828 | CAATTTCTACTCTCCCGTAGAT |
| 2173 | GAATTTCTACTGTGAGTAGAT | 2829 | CAATTGGATTTAAGTGGTCCT |
| 2465 | AAATTTCTACTTGCGGTAGAT | 2830 | AAATTTCTACTGGACTGTAGAT |
| 1342 | CAATTTCTACTTTAAGTAGAT | 2831 | CAATTGCACGTCTTCGTGCT |
| 2466 | GAATTTCTACTGTCGAGTAGAT | 2832 | CAATTGATGCTAAGTGCATCT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2467 | AAATTTCTACTTGATGTAGAT | 1261 | CAATTTCTACTCCGTTGTAGAT |
| 2468 | GAATTTCTACTAACAGGTAGAT | 2833 | CAATTCGCTGTCTTCGGTGT |
| 2469 | CAATTTCTACTTAAATGTAGAT | 2834 | CAATTTCTACTACGTCGTAGAT |
| 2470 | CAATTTTGCTAAGTGCAGGT | 2835 | CAATTTCTCCGGCAGGGAGAT |
| 2471 | CAATTTCTTCTAAGTGAAGGT | 2836 | CAATTTCTCCACGCGGAGAT |
| 2472 | CAATTTCTACTTGTTTGTAGAT | 2837 | GAATTGACGCTCTTGCGTTT |
| 1443 | GAATTTCTACTACGCAGTAGAT | 2838 | CAATTACTCTTCTTGGGGTT |
| 812 | CAATTTCTACTTTAGCGTAGAT | 2839 | CAATTTCTACTACCGGGTAGAT |
| 640 | GAATTTCTACTTACTGGTAGAT | 2840 | CAATTTCTACTCATCAGTAGAT |
| 1529 | CAATTTCTACTCGTGTAGAT | 2841 | GAATTTCTCCTACTTTGGAGAT |
| 2473 | AAATTTCTACTTAATTGTAGAT | 2842 | GAATTTCTCCCACCTAGGAGAT |
| 2474 | GAATTCCTCGTAAGTCGAGGT | 2843 | GAATTTCTACTGAGAGTAGAT |
| 2475 | GAATTTCTACTGGTGGGTAGAT | 2844 | GAATTTCTACGTCTCGTAGAT |
| 2295 | GAATTTCTACTCCACCGTAGAT | 2845 | AAATTGCGTCTAAGTGGCGTT |
| 2476 | AAATTTCTACTAACCGTAGAT | 2846 | CAATTTCTACGCGAAGTAGAT |
| 2106 | GAATTTCTACTTCAGTGTAGAT | 2847 | CAATTGCAGGTAAGTCTTGTT |
| 2477 | AAATTGGCACTAAGTGTGTTT | 2848 | GAATTTCTACTCCCCTGTAGAT |
| 2478 | GAATTTCTACTTTAGTGTAGAT | 2849 | CAATTTCTACTTCCGGGTAGAT |
| 2479 | GAATTTCTACTAATGTAGAT | 1489 | GAATTTCTACTTTCCCGTAGAT |
| 1707 | GAATTTCTACTATGGCGTAGAT | 2850 | GAATTTCTACTCCACTGTAGAT |
| 2480 | GAATTTCTACTCCATTGTAGAT | 2851 | CAATTGCGAGTAAGTCTTGTT |
| 1028 | GAATTTCTACTCTCGTGTAGAT | 2852 | CAATTGTGTTTCTTGACACT |
| 2481 | CAATTTCTACTACTCTGTAGAT | 2853 | CAATTTCTACGCCCGGTAGAT |
| 1237 | CAATTTCTACTACCGTAGAT | 2854 | GAATTTCTACTCCCTGTAGAT |
| 2482 | GAATTTCTACTCACTGTAGAT | 2855 | CAATTTCTACTTGTGAGTAGAT |
| 2483 | AAATTTCTACTCGTGAGTAGAT | 2856 | CAATTTCTACTGGCGTGTAGAT |
| 1283 | GAATTTCTACTCCCACGTAGAT | 2857 | CAATTGCCGGTAAGTCCGGTT |
| 2484 | CAATTTCTACTATGGAGTAGAT | 998 | GAATTTCTACTGTCGTAGAT |
| 1132 | CAATTTCTACTTGGTGTAGAT | 2858 | GAATTGCTGCTCTTGTGGCT |
| 617 | GAATTTCTACTAGGCGTAGAT | 2859 | CAATTTCTCCTAAAGCGGAGAT |
| 2485 | AAATTTCTACTGGGAGTAGAT | 2860 | CAATTTCTACTACCGTGTAGAT |
| 2486 | CAATTTCTACTTTTTCGTAGAT | 1853 | CAATTTCTACCGCACGTAGAT |
| 2487 | GAATTTCTACTGATCGTAGAT | 1221 | GAATTTCTACTCCGATGTAGAT |
| 2488 | CAATTTCTACTGATTTGTAGAT | 2861 | CAATTTCTCCTATGTTGGAGAT |
| 2489 | CAATTTCTACTAGAATGTAGAT | 2862 | GAATTTCTACTTGTGGGTAGAT |
| 1211 | CAATTTCTACTCGGAGTAGAT | 2863 | CAATTGCTGTTAAGTGCGGCT |
| 2490 | CAATTTCTACTACAGCGTAGAT | 1479 | CAATTTCTACTCTGGTAGAT |
| 1773 | CAATTTCTACTTTCGTAGAT | 846 | GAATTTCTACTTGTGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 1398 | CAATTTCGCCTAAGTGGCGAT | 2864 | GAATTGGTGGTCTTCCACTT |
| 674 | CAATTTCTACTGTGGTAGAT | 2865 | CAATTTCTCCTGCGTGGAGAT |
| 970 | GAATTTCTACTGCTTTGTAGAT | 2866 | CAATTTCGGGTCTTTCTGGT |
| 2491 | CAATTTCTACTACAAGTAGAT | 2867 | CAATTTCTACTGCCACGTAGAT |
| 2492 | GAATTTCTCCTAAGTGGAGAT | 2868 | CAATTTCTACTAGACGGTAGAT |
| 2493 | GAATTTCTACTACTGCGTAGAT | 2869 | CAATTTCTACTCTCCGTAGAT |
| 1160 | GAATTTCTACTTCTCGGTAGAT | 1356 | CAATTTCTACTCTAGAGTAGAT |
| 1306 | CAATTTCTACTCGTTGTAGAT | 602 | CAATTTCTACTATGGGGTAGAT |
| 2494 | CAATTTCTACTATCTAGTAGAT | 2870 | AAATTTCTACTACTGGTAGAT |
| 821 | AAATTTCTCCTACGTGGAGAT | 2871 | AAATTTCTACTTGAGCGTAGAT |
| 2087 | GAATTTCTACTGGGAGTAGAT | 2872 | CAATTGTTGCTCTTGCGGTT |
| 2495 | GAATTTCTACTTCGAGGTAGAT | 2873 | CAATTAGTCTTAAGTAGGTTT |
| 2496 | CAATTTCTACTTCTTGTAGAT | 784 | CAATTTCTACTCTATCGTAGAT |
| 2091 | CAATTTCTACTAGACCGTAGAT | 2874 | CAATTTCTACTTCTGGGTAGAT |
| 993 | CAATTTCTCCTACGAGGAGAT | 1070 | CAATTTCTACTGTCATGTAGAT |
| 2497 | CAATTTCTACTGTGATGTAGAT | 1366 | CAATTTCTACTGATGGGTAGAT |
| 2498 | CAATTTCTACTAGCGTGTAGAT | 1127 | GAATTTCTCCTCGGTGGAGAT |
| 2499 | AAATTTCTACTACATGTAGAT | 2875 | GAATTTCTACCAACGGTAGAT |
| 2500 | GAATTTCTACTGGTGAGTAGAT | 2308 | GAATTTCTACTCCATAGTAGAT |
| 2501 | GAATTTCTACTACCCTGTAGAT | 2876 | CAATTGGTTATAAGTTAATCT |
| 2502 | CAATTTCTACTCAATGTAGAT | 1406 | CAATTCCTAATAAGTTTAGGT |
| 2503 | GAATTTCTCCTATTAGGAGAT | 2877 | GAATTTCTACTCTATCGTAGAT |
| 1806 | CAATTTCTACTGTCGTAGAT | 950 | CAATTTCTCCTATCTGGAGAT |
| 929 | CAATTTCTACTTCCACGTAGAT | 2878 | CAATTACTGATCTTTCGGTT |
| 1079 | CAATTTCTACTCTACCGTAGAT | 919 | CAATTTCTACTATGCTGTAGAT |
| 638 | AAATTTCTACTTGCCTGTAGAT | 2879 | CAATTTCTCCTACGGTGGAGAT |
| 945 | CAATTTCTACTGTATCGTAGAT | 2880 | GAATTTCTACTACCGCGTAGAT |
| 2504 | AAATTTCTACTTTCGGTAGAT | 2881 | CAATTTCTACTCTGATGTAGAT |
| 2505 | CAATTTCGACTAAGTGTCGAT | 2882 | CAATTTCTACTGTGGGTAGAT |
| 2506 | CAATTTCTCCTACTGCGGAGAT | 2883 | GAATTTCTCCAGCCCAGGAGAT |
| 994 | CAATTTCTACTACACTGTAGAT | 2884 | CAATTTCTACTTTTATGTAGAT |
| 1788 | GAATTTCTACTTGCGTGTAGAT | 2885 | CAATTTGTGTCTTCGCGGT |
| 2507 | AAATTTCTCCTGGATGGGAGAT | 2886 | GAATTTCTACTAGCGTAGAT |
| 684 | GAATTTCTACTACTGAGTAGAT | 2887 | CAATTTCCATAAGTTGGAGT |
| 2508 | CAATTTCTACTATCGAGTAGAT | 837 | CAATTTCTACTACGAAGTAGAT |
| 1185 | CAATTTCTACTCCAGCGTAGAT | 1020 | CAATTTCTACTGTGTGTAGAT |
| 2509 | CAATTTCTACTCTGGTGTAGAT | 2888 | CAATTTCTACTTAGTGGTAGAT |
| 2510 | GAATTTCTACTCCTGTAGAT | 2889 | GAATTTCTACCGTAGAGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2511 | CAATTTCTCCTAGTGAGGAGAT | 2890 | CAATTGATGATCTTTCATTT |
| 2512 | CAATTTCTACTTCAAAGTAGAT | 2891 | CAATTGCGTCTCTTGACGTT |
| 641 | GAATTTCTACTACGCGTAGAT | 2892 | CAATTGGTGGTCTTCCACTT |
| 1852 | CAATTTCTACTATAGTAGAT | 2893 | CAATTTCTACTGAATGTAGAT |
| 2513 | CAATTTCTACTAGAGCGTAGAT | 2894 | CAATTTCTACTGTTGTAGAT |
| 2514 | GAATTTCTACTGTGTGTAGAT | 2895 | AAATTTCTACTCATAGTAGAT |
| 1328 | CAATTTCTACTTGCCGTAGAT | 294 | CAATTTTACGTCTTCGTGAT |
| 2515 | CAATTTCTACTTTGTAGTAGAT | 2896 | CAATTGGTCTTCTTAGATTT |
| 2516 | CAATTTCTACTTCAGAGTAGAT | 1651 | CAATTTCTACTACTTGTAGAT |
| 2517 | GAATTTCTACTAGCATGTAGAT | 1699 | CAATTTCTCCTTTGCGGAGAT |
| 1959 | AAATTTCTACTCATTCGTAGAT | 2897 | GAATTTCTCCCACCTGGAGAT |
| 2518 | CAATTTCTCCTATTGCGGAGAT | 2898 | CAATTTCTACTAGTTTGTAGAT |
| 589 | CAATTTCTACTACCGAGTAGAT | 2899 | CAATTCAGTGTCTTTGCTGT |
| 2519 | AAATTTCTACTGTACGTAGAT | 2900 | GAATTTCTCCTCCCGAGGAGAT |
| 2520 | AAATTTCTACTCGCATGTAGAT | 2901 | CAATTACGGCTAAGTGTCGTT |
| 2521 | CAATTTCTACTAAGGGTAGAT | 844 | CAATTTCTACTAACACGTAGAT |
| 1016 | GAATTTCTACTGCCATGTAGAT | 2902 | CAATTTCTACTCCCCGTAGAT |
| 2522 | CAATTTCTACCGGACGTAGAT | 2903 | CAATTCTGTCTAAGTGGTAGT |
| 790 | GAATTTCTACTCGTGGGTAGAT | 2904 | CAATTGTTATTAAGTGTAACT |
| 2523 | GAATTTCTACTTCTTCGTAGAT | 2905 | GAATTTCTCCAGAGTAGGAGAT |
| 2524 | GAATTTCTACTCCGTGTAGAT | 655 | CAATTTCTACTAGCTTGTAGAT |
| 1419 | AAATTTCTACCTCCAGTAGAT | 2906 | GAATTTCTACTGCGGTAGAT |
| 1178 | CAATTTCTACTAAGGTAGAT | 2907 | GAATTTCTCCCAGATGGGAGAT |
| 2525 | CAATTTCTACTAGTTGTAGAT | 2908 | CAATTGTGCTTCTTGGCGCT |
| 2526 | GAATTTCTACTAACTTGTAGAT | 2909 | CAATTACTAGTCTTTTGGTT |
| 1740 | GAATTTCTACTAGTGTAGAT | 2910 | CAATTTCTACTCGGGGTAGAT |
| 2527 | GAATTTCTACTACTGTGTAGAT | 2911 | CAATTTCTACTGAGCAGTAGAT |
| 2528 | AAATTTCTACTGAACGTAGAT | 2912 | GAATTGCGCTTAAGTAGTGCT |
| 2529 | CAATTTCTCCTGGGTGGAGAT | 2913 | CAATTGGCGTTCTTGCGTCT |
| 2530 | GAATTTCTACTCGACGTAGAT | 2914 | CAATTTCTACTTGCCAGTAGAT |
| 2531 | GAATTTCTACTCGCATGTAGAT | 2915 | CAATTACCAGTAAGTTTGGTT |
| 979 | CAATTTCTCCTAGGAGGAGAT | 804 | CAATTTCTACTATCCGGTAGAT |
| 2532 | CAATTTCTACTCGTAGTAGAT | 2916 | CAATTTAGGTTAAGTGCTTGT |
| 859 | CAATTTCTACTATGGTGTAGAT | 2917 | CAATTGGTGATAAGTTTACCT |
| 973 | CAATTTCTACTTCGCAGTAGAT | 2918 | CAATTTCTACTTTACTGTAGAT |
| 2105 | GAATTTCTACTTTCGCGTAGAT | 2919 | CAATTACTGGTCTTTTGGTT |
| 2533 | GAATTTCTCCTACGCGGAGAT | 2920 | CAATTTCTCATAAGTTGGGGT |
| 2534 | CAATTTCTACAATCGGTAGAT | 2921 | CAATTTCTACTTTGCCGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 891 | GAATTTCTACTGAAGTAGAT | 2922 | CAATTTCTACTACGGTGTAGAT |
| 2535 | CAATTTCTACTAAGTGTGGAT | 1279 | CAATTTCTACTCGCTCGTAGAT |
| 2536 | GAATTTCTACTTTCTAGTAGAT | 2923 | CAATTACCGATCTTTCGGTT |
| 2537 | AAATTTCTACTTGTGGTAGAT | 2924 | CAATTGAGCCTAAGTGGCTCT |
| 2538 | CAATTCTACTACTGAGTAGAT | 2925 | CAATTTGGGGTCTTCTTCAT |
| 2539 | CAATTTCTACTTAAGGTAGAT | 2926 | CAATTTCTACTGACTCGTAGAT |
| 2540 | GAATTTCTCCTAGGCGGAGAT | 2927 | CAATTCATGATCTTTTATGT |
| 2541 | CAATTTCTACTACGAGGTAGAT | 2928 | GAATTTCTACTGTAACGTAGAT |
| 2542 | CAATTCTGGGTAAGTCTTGGT | 1473 | CAATTTCTACTACAAGGTAGAT |
| 2543 | GAATTTCTACTTTAAGGTAGAT | 2929 | GAATTGCTGTTCTTACGGCT |
| 2544 | GAATTGACAGTCTTCTGTCT | 2930 | CAATTTCTCCCAATAGGAGAT |
| 2545 | GAATTTCTACTGGTCCGTAGAT | 2931 | CAATTCTACGTCTTCGTAGT |
| 659 | CAATTTCTACTAGGGGTAGAT | 2932 | CAATTGTTCTTCTTGGAATT |
| 2546 | CAATTTCTACTGTTAAGTAGAT | 2933 | GAATTTCTCCTAGTGAGGAGAT |
| 2547 | CAATTTCTACTACGCTGTAGAT | 2934 | GAATTTCTACTGGAATGTAGAT |
| 2548 | CAATTTCTACTTCGTGTAGAT | 2935 | CAATTTCTACATATCTGTAGAT |
| 1926 | GAATTTCTACTGCTCCGTAGAT | 2936 | CAATTGAAGTTCTTACTTCT |
| 2199 | CAATTTCTACTGTTCTGTAGAT | 2937 | GAATTTCTACTGAACGTAGAT |
| 1174 | CAATTTCTACTCTCATGTAGAT | 2938 | CAATTTCTACTTCCGTAGAT |
| 2549 | AAATTTCTACTCGATTGTAGAT | 2939 | CAATTTCTCCAGGAAAGGAGAT |
| 2550 | CAATTTCTACTTCTTAGTAGAT | 2940 | CAATTGACGTTCTTACGTCT |
| 2551 | AAATTTCTACTTCGTGTAGAT | 947 | CAATTTCTACTTTGACGTAGAT |
| 2552 | CAATTATGGCTCTTGTCGTT | 2941 | AAATTCGCGTTCTTACGCGT |
| 2553 | AAATTTCTACTTGTTAGTAGAT | 2942 | CAATTCACTCTCTTGGGTGT |
| 1519 | CAATTTCTACTTACTGTAGAT | 2943 | GAATTTCTCCTACTGCGGAGAT |
| 2554 | AAATTTCTACTGTCCGTAGAT | 2944 | GAATTTCTACTTAGCTGTAGAT |
| 2555 | CAATTTCTACTAATCTGTAGAT | 2945 | CAATTGGGCTTAAGTGGCCTT |
| 2556 | AAATTTCTACTACAAGGTAGAT | 2946 | CAATTTCGCCTAAGTGGTGAT |
| 1967 | GAATTTCTACTCGCGTAGAT | 2947 | GAATTTCTACTAGTCGGTAGAT |
| 1499 | CAATTTCTCCTAACGTGGAGAT | 2948 | GAATTACGTGTAAGTCACGTT |
| 1826 | GAATTTCTACTCAAGTAGAT | 2949 | CAATTTCTACTGAGGCGTAGAT |
| 1560 | CAATTTCTACTACAGAGTAGAT | 1042 | CAATTTCTACTTAGAAGTAGAT |
| 1771 | CAATTTCTACTAAACGTAGAT | 241 | CAATTGGTCGTCTTTGATTT |
| 2557 | AAATTTCTCCTAGGAGGAGAT | 1061 | CAATTTCTACTCGTTCGTAGAT |
| 2558 | GAATTTCTACTCAGGTAGAT | 2950 | CAATTCCCTGTAAGTCGGGGT |
| 2559 | CAATTTCTACTCGGCCGTAGAT | 2951 | AAATTTCTCCTTGGCGGAGAT |
| 2560 | CAATTTCTACTTATCCGTAGAT | 2952 | CAATTTCTCCGCTCCGGAGAT |
| 2561 | AAATTTCGCCTAAGTGGCGAT | 2953 | CAATTGTTTGTCTTCAAATT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2562 | AAATTTCTACTCGTGGTAGAT | 2954 | CAATTCCGAGTAAGTCTCGGT |
| 1073 | CAATTTCTACTGCTGTAGAT | 2955 | CAATTTATGTTCTTGTATAT |
| 1646 | CAATTTCTACTGATGTAGAT | 2264 | GAATTTCTACTCATGTGTAGAT |
| 2563 | CAATTTCTCCTTTGTGGAGAT | 2956 | CAATTCTCTCTCTTGAGAGT |
| 2564 | CAATTTCTACAAACTGTAGAT | 2957 | CAATTCTGGGTAAGTCTTAGT |
| 2565 | GAATTTCTCCTAGATGGAGAT | 1720 | CAATTTCTACTGCTGCGTAGAT |
| 2566 | CAATTTCTCCTAAGGTGGAGAT | 2958 | CAATTAGGAGTAAGTCTCCTT |
| 748 | CAATTTCTACTGTTGGGTAGAT | 2959 | GAATTGTTGATAAGTTTGGCT |
| 2567 | CAATTTCTACTTTTCAGTAGAT | 2960 | CAATTTCTACCTTCAGTAGAT |
| 2246 | GAATTTCTACTGGCGCGTAGAT | 2961 | CAATTGCGGTTCTTGTCGTT |
| 2568 | GAATTTCTACATCTGTAGAT | 2962 | GAATTTCTACCTTACGTAGAT |
| 2031 | CAATTTCTACTATTGGTAGAT | 2963 | GAATTTCTCCTCTGTGGAGAT |
| 2569 | AAATTTCTACTGTCTGTAGAT | 2964 | CAATTGGGCGTAAGTTGCTTT |
| 2570 | GAATTTCTACTTTCCGTAGAT | 2965 | CAATTTCTACCTTCCGGTAGAT |
| 2571 | AAATTTCTACTGTAAGTAGAT | 2966 | GAATTTGTGTTCTTACGTGT |
| 2572 | GAATTTCTACTGGTAAGTAGAT | 2967 | GAATTTCTACGGACTGTAGAT |
| 2573 | CAATTGGGTCTCTTGGCCTT | 2968 | CAATTTCTACTCACTGTAGAT |
| 2574 | AAATTCGACTTAAGTGGTCGT | 2969 | CAATTTCTACAGAATCGTAGAT |
| 2575 | GAATTTCTCCTGCGTGGAGAT | 2970 | CAATTAGTTCTCTTGGATTT |
| 2576 | CAATTAGCGCTCTTGTGTTT | 2971 | GAATTGGCTGTAAGTTGGTCT |
| 2577 | GAATTTCTACTAAGGAGTAGAT | 2972 | CAATTTCTACTGCAATGTAGAT |
| 2578 | CAATTTCTACTGTGTCGTAGAT | 1220 | CAATTAGTTGTAAGTCAGTTT |
| 2579 | CAATTTCTACTACAGTAGAT | 913 | CAATTTCTACTCCCCCGTAGAT |
| 574 | CAATTTCTACTTTGCGTAGAT | 2973 | CAATTTCTACCACACGTAGAT |
| 2580 | GAATTTCTCCTATGCGGAGAT | 2974 | CAATTTCTACTGAAATGTAGAT |
| 1989 | GAATTTCTACTTGGCCGTAGAT | 2975 | CAATTTCTCCTACCTGGAGAT |
| 2581 | AAATTTCTACTCCCCTGTAGAT | 2976 | CAATTGGTCTTAAGTGGGTCT |
| 2582 | CAATTTCTACTTTTTTGTAGAT | 2977 | CAATTTCTACCGATGGTAGAT |
| 2583 | GAATTTCTACTTCTTAGTAGAT | 2978 | GAATTTCTCCTATGGAGGAGAT |
| 1098 | CAATTTCTACTCCATTGTAGAT | 2979 | CAATTATGGTTCTTGTCATT |
| 2584 | GAATTTCTACTCGTGCGTAGAT | 2980 | CAATTTTAGCTCTTGTTGAT |
| 1804 | GAATTTCTACTTGAGGTAGAT | 1671 | CAATTGTTTATCTTTAGGCT |
| 2585 | AAATTTCTCCTAGGTGGAGAT | 2981 | CAATTTCTACTCTCGGGTAGAT |
| 686 | CAATTTCTACTTCTCTGTAGAT | 2982 | CAATTGGTCTTCTTAGGCCT |
| 1320 | CAATTTCTACTTCGTTGTAGAT | 2983 | AAATTTCTACTTACGGGTAGAT |
| 2586 | GAATTTCTACTGTACGTAGAT | 2984 | GAATTGCTGCTCTTGCAGTT |
| 1050 | GAATTTCTCCTACCGTGGAGAT | 2985 | CAATTGCCGCTAAGTGCGGCT |
| 2587 | CAATTGTGTGTAAGTTACGCT | 2986 | CAATTGGTTTTAAGTGGGTTT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2588 | GAATTTCTCCTAGTGCGGAGAT | 2987 | CAATTGCGGCTCTTGTTGCT |
| 930 | AAATTTCTCCTAAGGGGAGAT | 2988 | CAATTTCTGATAAGTTCAGAT |
| 918 | CAATTTCTACTAATCGTAGAT | 2989 | AAATTTCTACTACCATGTAGAT |
| 2589 | CAATTTCTACTTGTGTAGAT | 915 | CAATTTCTCCTACACGGAGAT |
| 2590 | CAATTTCTACTTTCTGTAGAT | 964 | CAATTTCTACTGTTGTGTAGAT |
| 1161 | CAATTTCTACTGTACGTAGAT | 1343 | CAATTTCTACTATTAGGTAGAT |
| 2591 | CAATTCGAATTCTTATTCGT | 2990 | CAATTTCTACACCGGTGTAGAT |
| 2592 | CAATTTCTACTATTAAGTAGAT | 2991 | CAATTTCTACTCAATAGTAGAT |
| 2593 | GAATTTCTACTGATTAGTAGAT | 2992 | CAATTTCAGTTAAGTGTTGAT |
| 656 | CAATTTCTACTGACAGTAGAT | 2993 | CAATTAATGTTCTTATGTTT |
| 2594 | GAATTTCTACTAGGGCGTAGAT | 2994 | CAATTGGTTTTCTTAAGCCT |
| 2595 | GAATTCGGGGTAAGTCTCTGT | 2995 | CAATTGACTTTCTTAAGTCT |
| 2596 | CAATTTCTACTTGATTGTAGAT | 2996 | CAATTAGTGGTAAGTCCACTT |
| 2077 | GAATTTCTACTCGCAGTAGAT | 2997 | CAATTCCCTCTCTTGGGGGT |
| 2597 | CAATTTCTACTTCGGAGTAGAT | 2998 | CAATTTCTACTTATGAGTAGAT |
| 847 | GAATTTCTACTTCTAAGTAGAT | 2999 | GAATTTCTACCACTTGTAGAT |
| 2598 | GAATTTCTACTGGTTCGTAGAT | 1162 | CAATTTCTACTCTACTGTAGAT |
| 2599 | GAATTGGTTCTAAGTGAGCCT | 3000 | CAATTTCTACTCACGCGTAGAT |
| 2600 | AAATTGTGGGTAAGTCTCGTT | 1001 | CAATTTCTCCTAAGGAGGAGAT |
| 1828 | CAATTTCTACTAACCTGTAGAT | 3001 | CAATTCTAAGTAAGTCTTGGT |
| 1632 | CAATTTCTACTGGCTCGTAGAT | 3002 | CAATTTCTACCTCCCGTAGAT |
| 2601 | AAATTTCTCCTAAGAGGGAGAT | 3003 | CAATTCGGGTTAAGTACTTGT |
| 2602 | AAATTTCTCCTATGCGGAGAT | 3004 | GAATTTCTCCATCCCGGGAGAT |
| 2603 | GAATTTCTACTACCGAGTAGAT | 3005 | CAATTTCTACTACATGGTAGAT |
| 2604 | CAATTTCTACTGATAAGTAGAT | 3006 | CAATTGCGAGTAAGTTTCGTT |
| 2605 | CAATTTCTACTGTATGTAGAT | 3007 | CAATTGGTTTTCTTGAGTTT |
| 1246 | CAATTTCTACTCTAGGTAGAT | 681 | CAATTTCTACTGAAAGTAGAT |
| 2606 | AAATTTCTCCTAATGAGGAGAT | 3008 | CAATTTCTACTCGATGTAGAT |
| 2607 | GAATTTCTACTGTCTTGTAGAT | 3009 | CAATTTCTACTAGGCCGTAGAT |
| 2608 | GAATTTCTACTATCGCGTAGAT | 3010 | CAATTTCTACTTACATGTAGAT |
| 596 | GAATTTCTACTATCATGTAGAT | 3011 | GAATTTCTACTGCGTGTAGAT |
| 1099 | CAATTTCTACTCACGTAGAT | 3012 | CAATTTCTCCTACGGCGGAGAT |
| 1798 | GAATTTCTACTCCCAGTAGAT | 861 | CAATTTCTCCTACAGGAGAT |
| 2609 | GAATTTCTACTTGGATGTAGAT | 741 | GAATTTCTACTCTTACGTAGAT |
| 2282 | CAATTTCTACTTAAGCGTAGAT | 3013 | CAATTTGCCTTAAGTAGGCAT |
| 1537 | CAATTTCTACTGTTCGGTAGAT | 1177 | CAATTTCTCCTACTGAGGAGAT |
| 2610 | GAATTTCTACACTCCAGTAGAT | 3014 | CAATTTCTACTTCCTAGTAGAT |
| 2611 | CAATTTCTACTTTAAGGTAGAT | 3015 | AAATTTCTACACGTACGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2612 | GAATTGGGTGTCTTCATTCT | 3016 | CAATTGCTCTTCTTAGAGCT |
| 2613 | CAATTTCTACTTTCGGTAGAT | 3017 | AAATTTCTACGCACCGTAGAT |
| 2614 | CAATTTCTCCTACCGAGGAGAT | 2226 | GAATTTCTACTTCGATGTAGAT |
| 2231 | GAATTTCTACTCGCCTGTAGAT | 3018 | CAATTATTTGTCTTCGGATT |
| 2615 | GAATTTCTACTATCGGTAGAT | 1405 | CAATTTCTACTGCGAGTAGAT |
| 2616 | AAATTCCTACTAAGTGTGGGT | 1124 | CAATTTCTCCTATCGTGGAGAT |
| 1626 | GAATTTCTACTTCCACGTAGAT | 3019 | GAATTGGTCGTAAGTCGATTT |
| 668 | CAATTTCTACTTTAGTGTAGAT | 3020 | CAATTTCTACTGCCGGTAGAT |
| 1325 | CAATTTCTACTCCTCTGTAGAT | 3021 | GAATTTCTACTGCTTGGTAGAT |
| 2617 | GAATTTCTACCACAAGTAGAT | 3022 | GAATTTCTACGATCCCGTAGAT |
| 682 | GAATTTCTCCTATCGCGGAGAT | 3023 | CAATTTCTACTGTCAGGTAGAT |
| 2618 | CAATTTCTACTGCCATGTAGAT | 3024 | CAATTTCTACTACTGCGTAGAT |
| 2619 | GAATTTCTACTTGTGAGTAGAT | 3025 | GAATTCGCGTTCTTACGCGT |
| 2620 | CAATTTCTACTCTGGAGTAGAT | 3026 | CAATTTGACGTCTTCGTTGT |
| 2621 | CAATTTCTCCTAGAGAGGAGAT | 3027 | CAATTTTGTTTAAGTGACGAT |
| 2622 | CAATTTCTACTGGGGTAGAT | 3028 | CAATTCATATTAAGTGTGTGT |
| 2623 | CAATTTCTACTCTTCTGTAGAT | 1815 | GAATTTCTACTTGCGGTAGAT |
| 2624 | GAATTTCTACTCCGACGTAGAT | 3029 | CAATTTCTACTATATGTAGAT |
| 2625 | GAATTGGTGGTCTTCTATTT | 3030 | GAATTTCTACTTGCAGTAGAT |
| 2626 | GAATTTCTACCCTCTGTAGAT | 579 | GAATTTCTACTTAGAGTAGAT |
| 2627 | GAATTTCTACTTGAAGGTAGAT | 2138 | CAATTTCTACTGTGAGTAGAT |
| 2329 | GAATTTCTACTTCGTGTAGAT | 3031 | CAATTATACGTCTTTGTGTT |
| 2628 | AAATTTCTACTCCTTGGTAGAT | 3032 | CAATTAGTTGTAAGTTGACTT |
| 2629 | CAATTTCTACTTGGAGTAGAT | 3033 | GAATTGTGGCTCTTGCCGTT |
| 2630 | GAATTTCTACAATACGGTAGAT | 3034 | AAATTTCTACTAACCCGTAGAT |
| 799 | CAATTTCTACTGTTGGTAGAT | 3035 | AAATTTCTACTTCGAAGTAGAT |
| 2631 | CAATTGTGCATCTTTGTGCT | 3036 | GAATTTCTACTAACCGTAGAT |
| 2632 | CAATTTAGCATAAGTTGCTAT | 1686 | CAATTTCTACTCCTGGTAGAT |
| 1352 | CAATTTCTACTTCTCGGTAGAT | 3037 | GAATTTCTACTTAGGAGTAGAT |
| 2633 | AAATTTCTCCTCACGCGGAGAT | 3038 | AAATTCGCGTTCTTACGTGT |
| 2634 | AAATTGGCGCTAAGTGCGCTT | 3039 | GAATTTCTACCCTTAGTAGAT |
| 2635 | CAATTTCTACTGCGTGTAGAT | 3040 | CAATTGTCTTTCTTGAGATT |
| 2636 | CAATTTCTACTGCATTGTAGAT | 3041 | CAATTTCTACGAGACTGTAGAT |
| 907 | CAATTTCTACTCTGTAGTAGAT | 3042 | CAATTATCCTTCTTGGGGTT |
| 2637 | AAATTGACACTAAGTGTGTCT | 3043 | CAATTTCTACTCAGGGTAGAT |
| 2638 | CAATTTCTACTCATTCGTAGAT | 3044 | GAATTTCTCCTGGGTGGAGAT |
| 1006 | CAATTTCTACTTCGCCGTAGAT | 3045 | CAATTTCTACTGCTTCGTAGAT |
| 888 | CAATTTCTACTCCTTAGTAGAT | 3046 | GAATTTGGGGTAAGTTCCCGT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2639 | CAATTAGCTTTCTTAAGTTT | 1912 | GAATTTCTACTGCCGTAGAT |
| 1110 | CAATTTCTACTGCCTTGTAGAT | 3047 | CAATTCCTATTAAGTGTGGGT |
| 2640 | AAATTTCTCCTACGCTGGAGAT | 3048 | CAATTTAGGCTCTTGTCTAT |
| 435 | CAATTCCGCGTCTTTGTGGT | 3049 | CAATTAGGCATCTTTGTTTT |
| 2641 | CAATTTCTACTTTCACGTAGAT | 3050 | CAATTCGGACTAAGTGTCCGT |
| 908 | CAATTTCTACTCTTATGTAGAT | 3051 | AAATTTCTCCACAATGGGAGAT |
| 858 | GAATTTCTACTCCTCTGTAGAT | 2227 | CAATTTCTACTTAGCCGTAGAT |
| 2642 | AAATTTCTACTACGTTGTAGAT | 176 | CAATTGTGCGTAAGTTGCGCT |
| 1069 | CAATTTCTACTAACGCGTAGAT | 3052 | CAATTCCCGTCTTCGGGGT |
| 2643 | GAATTGTGTATCTTTGTGCT | 3053 | CAATTTCTACAATATGTAGAT |
| 921 | CAATTTCTACTTAGCTGTAGAT | 3054 | CAATTTCTACTGGAAGTAGAT |
| 2644 | AAATTTCTACTAGTGCGTAGAT | 1330 | CAATTTCTACTCAGTGTAGAT |
| 905 | CAATTTCTACTCCCTTGTAGAT | 1260 | CAATTTCTCCTTTGAGGAGAT |
| 2645 | CAATTTCTACTCTTTGTAGAT | 3055 | CAATTTCTACTTACTAGTAGAT |
| 2646 | CAATTTGTGTTCTTGTACGT | 3056 | CAATTAGCTTTAAGTGAGTTT |
| 2647 | CAATTTCTACTGCCGTGTAGAT | 3057 | GAATTCGTCTTCTTGGGCGT |
| 2648 | CAATTTCTACTTTATAGTAGAT | 3058 | CAATTACAAGTAAGTCTTGTT |
| 2649 | CAATTTCTACTGCACTGTAGAT | 3059 | CAATTTTGGTCTTTCGGGT |
| 1767 | AAATTTCTACTGAATGTAGAT | 3060 | GAATTTCTACACCCTGTAGAT |
| 2650 | GAATTTCTACTTACAGGTAGAT | 3061 | CAATTTCTACTGCGGTAGAT |
| 2651 | GAATTAGGTCTAAGTGGCTTT | 3062 | CAATTGTGACTAAGTGTTATT |
| 2652 | CAATTTCTACTAACGTAGAT | 3063 | GAATTGCCTGTAAGTCAGGTT |
| 2653 | GAATTTCTACTCGTTGGTAGAT | 3064 | CAATTTCTACACTCATGTAGAT |
| 2654 | CAATTCTGATTCTTGTCGGT | 3065 | CAATTTCTACTGTCTTGTAGAT |
| 2655 | CAATTTCTACTCCGGTGTAGAT | 3066 | CAATTCACTCTCTTGAGTGT |
| 763 | CAATTTCTACTATGGTAGAT | 3067 | GAATTGGTGTTCTTGCGCCT |
| 898 | AAATTTCTACTGCCGTAGAT | 3068 | CAATTTCTACTGATGTGTAGAT |
| 2656 | CAATTTCTACTCCCTCGTAGAT | 3069 | GAATTTCTACTATTAGTAGAT |
| 1348 | CAATTTCTACTTGTCAGTAGAT | 3070 | CAATTAGGTTAAGTGTCTGT |
| 1400 | CAATTTCTACTATTCGTAGAT | 3071 | GAATTTCTACGACTTGTAGAT |
| 1005 | CAATTTCTACTTAGGTAGAT | 3072 | CAATTACTTGTAAGTTGAGTT |
| 1716 | CAATTTCTACTCTCTCGTAGAT | 3073 | CAATTTCTACTCCCAGTAGAT |
| 2037 | CAATTTCTACTGCCCGTAGAT | 3074 | GAATTCACTGTCTTCGGTGT |
| 2657 | CAATTTCTACTAGTGCGTAGAT | 3075 | GAATTTCTCCTAACTGGAGAT |
| 2658 | CAATTGCTCGTCTTCGAGCT | 1851 | CAATTTCTACTTCCTCGTAGAT |
| 2659 | CAATTTCTACATCACCGTAGAT | 3076 | AAATTCTGTGTAAGTCATGGT |
| 2660 | AAATTTCTACTTCAAGGTAGAT | 2036 | GAATTTCTACTAGTAAGTAGAT |
| 2661 | CAATTTCTACTATGTGGTAGAT | 3077 | CAATTTCTACTGGCGCGTAGAT |

TABLE 5-continued

WT_1b provides identified gRNA sequences that bind LbCas12a protein.

| SEQ ID NO | gRNA Sequence | SEQ ID NO | gRNA Sequence |
|---|---|---|---|
| 2662 | GAATTTCTACTCGTAGTAGAT | 3078 | CAATTAGTCGTCTTCGATTT |
| 2663 | CAATTTCTACTCTCACGTAGAT | 3079 | GAATTTCTACTATGTGGTAGAT |
| 806 | CAATTTCTACTGTGGCGTAGAT | 2048 | CAATTTCTACTTTCTCGTAGAT |
| 2664 | CAATTTCTACTTACGAGTAGAT | 3080 | GAATTTCTACTGCTGTAGAT |
| 1034 | CAATTTCTACTGCAGAGTAGAT | 3081 | CAATTTCTACTTTTACGTAGAT |
| 2665 | GAATTTCTACTATCCGTAGAT | 3082 | CAATTTATGGTCTTCCATAT |
| 2666 | GAATTTCTACTACACGTAGAT | 3083 | CAATTTCTACTAGACGTAGAT |
| 637 | CAATTTCTACTATTTGTAGAT | 3084 | CAATTTTTTCTAAGTGAGGGT |
|  |  | 1032 | CAATTTCTACTATGCAGTAGAT |
|  |  | 3085 | GAATTTCTCCGCAATGGGAGAT |
|  |  | 3086 | CAATTTGTGCTAAGTGTGTGT |
|  |  | 3087 | CAATTCGCTCTCTTGAGTGT |

TABLE 6

En_as Consensus Sequences that bind enAsCas12a protein.
These gRNA consensus sequences are SEQ ID NO: 3088-3107

| SEQ ID NO | CONSENSUS SEQUENCE | SEQ ID NO: | CONSENSUS SEQUENCE |
|---|---|---|---|
| 3088 | CAATTYYKKYTCTTGWNGGT | 3098 | CAATTBGYGYTCTTRYGYDT |
| 3089 | CAATTRYRYGTAAGTYGBGYT | 3099 | CAATTGGHYBTCTTBGDYYT |
| 3090 | CAATTGKYKYTAAGTGYGKYT | 3100 | CAATTGYGBYTAAGTGNYGYT |
| 3091 | CAATTRYKGBTCTTBYDGYT | 3101 | MAATTGYGYCTCTTGRYGYT |
| 3092 | VAATTCGKYBTAAGTNGNYGT | 3102 | CAATTYGNYSTCTTBGKYGT |
| 3093 | CAATTDCYYKTCTTDGRGHT | 3103 | CAATTRGRBYTAAGTGDYCYT |
| 3094 | CAATTKGKGKTCTTKYBYYT | 3104 | CAATTYYGYGTCTTYRYGGT |
| 3095 | CAATTRGKGGTAAGTCCNYYT | 3105 | CAATTYGYGBTAAGTRYGYGT |
| 3096 | CAATTYCBGGTAAGTYYSGGT | 3016 | CAATTRYGYGTCTTYGYGYT |
| 3097 | GAATTGTNYGTCTTCGNGCT | 3107 | CAATTYYKRYTAAGTGYYGGT |

TABLE 7

RR_1b Consensus Sequences that bind LbCas12a(RR) protein.
These gRNA sequences are SEQ ID NO: 3108-3156.

| SEQ ID NO | CONSENSUS SEQUENCE | SEQ ID NO | CONSENSUS SEQUENCE |
|---|---|---|---|
| 3108 | RAATTTCTACTARGYGTAGAT | 3133 | CAATTTCTACTRYYYGTAGAT |
| 3109 | RAATTTCTACTRGYGYGTAGAT | 3134 | CAATTTCTACTMRAGRGTAGAT |
| 3110 | GAATTTCTACTRYYGRGTAGAT | 3135 | RAATTTCTCCTADRKYGGAGAT |
| 3111 | GAATTTCTACTDYYYGTAGAT | 3136 | CAATTTCTACTYDGGYGTAGAT |
| 3112 | RAATTTCTACTRCWWGTAGAT | 3137 | CAATTTCTCCTANGWGGAGAT |
| 3113 | RAATTTCTACTRYRRYGTAGAT | 3138 | CAATTTCTACTRHYRGTAGAT |

TABLE 7-continued

RR_1b Consensus Sequences that bind LbCas12a(RR) protein.
These gRNA sequences are SEQ ID NO: 3108-3156.

| SEQ ID NO | CONSENSUS SEQUENCE | SEQ ID NO | CONSENSUS SEQUENCE |
|---|---|---|---|
| 3114 | GAATTTCTACTYYDRYGTAGAT | 3139 | CAATTTCTACTWCRDRGTAGAT |
| 3115 | GAATTTCTACTRRNCDGTAGAT | 3140 | CAATTTCTACTGYRGYGTAGAT |
| 3116 | GAATTTCTACTBBBGTAGAT | 3141 | CAATTTCTACTRRYRGGTAGAT |
| 3117 | GAATTTCTACTRGYHGTAGAT | 3142 | RAATTTCTACTMYRYGTAGAT |
| 3118 | GAATTTCTACTYRHHCGTAGAT | 3143 | GAATTTCTCCTAYVYHGGAGAT |
| 3119 | GAATTTCTACTCDYYRGTAGAT | 3144 | CAATTTCTACTYRGYRGTAGAT |
| 3120 | RAATTTCTCCTANYGYGGAGAT | 3145 | CAATTTCTACTRHDGTAGAT |
| 3121 | CAATTTCTACTRRGWGTAGAT | 3146 | CAATTTCTACTYYDGGTAGAT |
| 3122 | GAATTTCTACTDYGYGGTAGAT | 3147 | VAATTRKNKRTAAGTYMSSYT |
| 3123 | RAATTTCTCCTAHGHGGAGAT | 3148 | CAATTTCTACTCCYMRGTAGAT |
| 3124 | CAATTTCTACTHYYYYGTAGAT | 3149 | CAATTTCTACTCRYHCGTAGAT |
| 3125 | CAATTTCTACTWCYRHGTAGAT | 3150 | CAATTCTCCTABBYYGGAGAT |
| 3126 | CAATTTCTACTYCRYYGTAGAT | 3151 | CAATTTCTACTRRCYYGTAGAT |
| 3127 | CAATTTCTCCTANBGNGGAGAT | 3152 | GAATTTCTACYYYYNGTAGAT |
| 3128 | CAATTTCTACTRDRYYGTAGAT | 3153 | CAATTTCTACTHRYNGTAGAT |
| 3129 | CAATTTCTACTYYRYGTAGAT | 3154 | CAATTTCYMHTCTTGKRGRT |
| 3130 | CAATTTCTACTRYRRGTAGAT | 3155 | CAATTTCTACTYGYWRGTAGAT |
| 3131 | CAATTTCTACTRRYRYGTAGAT | 3156 | SAATTGKKYRTCTTYDNVYT |
| 3132 | CAATTTCTCCTAYYWGGAGAT | | |

TABLE 8

WT_as Consensus Sequences that bind AsCas12a (wild type) protein.
These gRNA are SEQ ID NO: 3157-3184.

| SEQ ID NO | CONSENSUS SEQUENCE | SEQ ID NO | CONSENSUS SEQUENCED |
|---|---|---|---|
| 3157 | GAATTTCTACTRYMYYGTAGAT | 3171 | GAATTTCTCCVYDSCNGGAGAT |
| 3158 | SAATTTCTACTYWHGTAGAT | 3172 | CAATTTCTACTRRRWGTAGAT |
| 3159 | CAATTYRKKBTAAGTKNDYGT | 3173 | SAATTKBGYRTCTTYGYDST |
| 3160 | SAATTTCTACTRHNGTAGAT | 3174 | MAATTTCTACWCVRYGTAGAT |
| 3161 | RAATTTCTCCNHVBVGGAGAT | 3175 | CAATTTCTACTBNYRYGTAGAT |
| 3162 | SAATTTCTCCTMHHGGAGAT | 3176 | CAATTTCTACTYNYYYGTAGAT |
| 3163 | GAATTTCTACTDVVVGTAGAT | 3177 | CAATTGHKKKTAAGTNBBDYT |
| 3164 | GAATTTCTACTRYRGYGTAGAT | 3178 | CAATTTCTCCDDWRNNGGAGAT |
| 3165 | MAATTGKYYRTCTTYGGSYT | 3179 | CAATTRRYGRTCTTYYRYBT |
| 3166 | RAATTTCTACTYDCRYGTAGAT | 3180 | CAATTTCTACTDHRYYGTAGAT |
| 3167 | CAATTTCTACHRYYYGTAGAT | 3181 | CAATTDGKNYTCTTGDVYKT |
| 3168 | GAATTTCTACTRRWWHGTAGAT | 3182 | CAATTYYGRRTCTTNYYRGT |

TABLE 8-continued

WT_as Consensus Sequences that bind AsCas12a (wild type) protein.
These gRNA are SEQ ID NO: 3157-3184.

| SEQ ID NO | CONSENSUS SEQUENCE | SEQ ID NO | CONSENSUS SEQUENCED |
|---|---|---|---|
| 3169 | GAATTTCTACTCNHYCGTAGAT | 3183 | GAATTTCTMCKYYGWHGKAGAT |
| 3170 | CAATTTCTCCNHMRKGGAGAT | 3184 | CAATTTCTCCCMSRMYGGAGAT |

TABLE 9

WT_1b Consensus sequences that bind LbCas12a protein.
These gRNA sequences are SEQ ID NO: 3185-3225.

| SEQ ID NO | CONSENSUS SEQUENCE | SEQ ID NO: | CONSENSUS SEQUENCE |
|---|---|---|---|
| 3185 | RAATTTCTACTRRGYGTAGAT | 3206 | RAATTTCTCCTARGTGGAGAT |
| 3186 | RAATTTCTACTDYRYGTAGAT | 3207 | CAATTTCTACTWWYGRGTAGAT |
| 3187 | GAATTTCTACTHCRGYGTAGAT | 3208 | CAATTTCTACTRYDRYGTAGAT |
| 3188 | CAATTTCTACTRGCDGTAGAT | 3209 | CAATTTCTACTDRYYGTAGAT |
| 3189 | GAATTTCTACTRKDYYGTAGAT | 3210 | CAATTTCTACTYDYYGTAGAT |
| 3190 | GAATTTCTACTRHYGMGTAGAT | 3211 | CAATTTCTACTRYBGTAGAT |
| 3191 | GAATTTCTACTHRYKRGTAGAT | 3212 | CAATTTCTACTRDRYHGTAGAT |
| 3192 | CAATTTCTACTRRGWGTAGAT | 3213 | CAATTTCTACTWYRRRGTAGAT |
| 3193 | RAATTTCTACTDYYYGTAGAT | 3214 | CAATTTCTCCTAHSHGGAGAT |
| 3194 | RAATTTCTACTHRRGYGTAGAT | 3215 | CAATTTCTCCTAYKGWGGAGAT |
| 3195 | RAATTTCTACTYCNRRGTAGAT | 3216 | CAATTTCTACTWYYYRGTAGAT |
| 3196 | GAATTTCTACTYCYYYGTAGAT | 3217 | CAATTTCTACTYYGYYGTAGAT |
| 3197 | CAATTTCTACTRYDYGTAGAT | 3218 | CAATTTCTACTYYYWYGTAGAT |
| 3198 | GAATTTCTACTVBBGTAGAT | 3219 | MAATTGGYGCTAAGTGYRCCT |
| 3199 | CAATTTCTACTWRWRWGTAGAT | 3220 | CAATTNCYNGTAAGTCKRGKT |
| 3200 | GAATTTCTACTRHDYRGTAGAT | 3221 | RAATTTCTCCWRVNBRGGAGAT |
| 3201 | CAATTTCTACTARYGYGTAGAT | 3222 | CAATTNCRCGTCTTCGWGBT |
| 3202 | GAATTTCTACTYDYRGTAGAT | 3223 | CAATTNDGYYTAAGTGGCBNT |
| 3203 | GAATTTCTCCTAYBYGGAGAT | 3224 | SAATTSRYGKTCTTMCRYBT |
| 3204 | CAATTTCTACTHYHGGTAGAT | 3225 | CAATTSDKYYTCTTGRSBBT |
| 3205 | GAATTTCTCCTAYYGYGGAGAT | | |

TABLE 10 provides consensus sequences for identified gRNA molecules that bind enAsCas12a protein.

| SEQ ID NO | Consensus Sequence |
|---|---|
| 3226 | CAATTANDYSTAAGTBSKDTT |
| 3227 | CAATTBKKSWTAAGTWSBBKT |
| 3228 | CAATTSVBSYTCTTGKSBST |
| 3229 | CAATTDSKWSTCTTSWBSBT |
| 3230 | CAATTWBBSBTCTTBSNKWT |
| 3231 | CAATTBSSWSTAAGTSWBSBT |
| 3232 | CAATTSKKYSTCTTSGWBST |

TABLE 10-continued provides consensus sequences for identified gRNA molecules that bind enAsCas12a protein.

| SEQ ID NO | Consensus Sequence |
|---|---|
| 3233 | CAATTSSYKWTCTTWBSYST |
| 3234 | CAATTKKKGBTAAGTSYSSST |
| 3235 | CAATTSYDYSTAAGTSGHKST |

TABLE 11 provides consensus sequences for identified gRNA molecules that bind AsCas12a (wild type) protein.

| SEQ ID NO | Consensus Sequence |
|---|---|
| 3236 | SAATTTCTACTVWHGTAGAT |
| 3237 | AAATTTCTACTSVBWYGTAGAT |
| 3238 | SAATTTCTACTVSBWGTAGAT |
| 3239 | SAATTTCTACTSHHBYGTAGAT |
| 3240 | SAATTTCTACTSWSHGTAGAT |
| 3241 | CAATTKDKKKTAAGTSBBDST |
| 3242 | CAATTGKBWDTCTTKKSSYT |
| 3243 | SAATTTCTCCTMHHGGAGAT |
| 3244 | SAATTTCTACTWWBDHGTAGAT |
| 3245 | SAATTTCTCCVHMVVGGAGAT |
| 3246 | SAATTTCTACTHBWSGTAGAT |
| 3247 | CAATTBWBBVTCTTKKBWST |
| 3248 | SAATTTCTACTWSWHYGTAGAT |
| 3249 | SAATTNSKSSTCTTSBDBKT |
| 3250 | SAATTTCTCCBNBVVBGGAGAT |

TABLE 12 provides consensus sequences for identified gRNA molecules that bind LbCas12a protein.

| SEQ ID NO: | Consensus Sequences |
|---|---|
| 3251 | AAATTTCTACTDNNHGTAGAT |
| 3252 | SAATTTCTACTAWSBGTAGAT |
| 3253 | SAATTTCTACTASWGHGTAGAT |
| 3254 | SAATTTCTACTBSSHGTAGAT |
| 3255 | SAATTTCTACTABYGTAGAT |
| 3256 | SAATTTCTACTWBBWBGTAGAT |
| 3257 | SAATTTCTACTWHSGHGTAGAT |
| 3258 | SAATTTCTACTSBWSNGTAGAT |
| 3259 | SAATTTCTACTGHMGTAGAT |
| 3260 | SAATTTCTACTNHSGTAGAT |

TABLE 12-continued provides consensus sequences for identified gRNA molecules that bind LbCas12a protein.

| SEQ ID NO: | Consensus Sequences |
|---|---|
| 3261 | SAATTTCTACTSWBWHGTAGAT |
| 3262 | SAATTTCTACTVBWHGTAGAT |
| 3263 | SAATTKCKSCTAWGTGGMGMT |
| 3264 | CAATTBSWSGTCTTSSWBNT |
| 3265 | SAATTSVYKYTCTTRSGYST |

TABLE 13 provides consensus sequences for identified gRNA molecules that bind LbCas12a(RR) protein.

| SEQ ID NO | Consensus Sequence |
|---|---|
| 3266 | SAATTTCTMCTAWSHGKAGAT |
| 3267 | VAATTTCTMCTASKHGKAGAT |
| 3268 | SAATTTCTACTVHWSBGTAGAT |
| 3269 | MAATTBCTCCTMTTGGAGRT |
| 3270 | SAATTTCTACTHSWWNGTAGAT |
| 3271 | SAATTTCTACTVBSSNGTAGAT |
| 3272 | SAATTTCTACTVWSWHGTAGAT |
| 3273 | SAATTTCTACTVHSGTAGAT |
| 3274 | SAATTTCTACTBBWGTAGAT |
| 3275 | SAATTTCTCCTAHBKYGGAGAT |
| 3276 | SAATTTCTACTSBBWGTAGAT |
| 3277 | CAATTTCTACTHRWSGTAGAT |
| 3278 | VAATTSSNBSTAAGTKSNSST |
| 3279 | CAATTBSSVWTCTTKBSSST |
| 3280 | CAATTGTTSDTCTTKGAAYT |

In some embodiments of the invention, gRNAs described herein are used to develop virus-resistant cells. gRNAs of the invention, as provided herein can be used reliably cut one or more target genetic elements in cells and subjects. The methods may include constructing a minimally repetitive array of sequence variants capable of directing one or more RNA-guided nucleases to cut the one or more sequences present within one or more target genetic elements. In some embodiments of the invention, one or more target genetic elements are one or more genes of a target organism. It is possible using methods and/or compositions of the invention to encode one or more minimally repetitive arrays within the genome of an organism. In certain embodiments, the cutting of the one or more genes at more than one sequence per gene reduces the likelihood that a mutant gene in the population is not cut. In some embodiments, the cutting of the one or more genes at the one or more target sequences increases a frequency of an occurrence of an engineered construct within a population of the relevant organism. Methods and compositions of the invention can be used to target viruses. For example in some embodiments of the invention, a target sequence corresponds to a viral sequence, and cutting the one or more viral target sequences can be used to confer resistance to the virus. In a non-limiting example, an array that results in cutting one or more viral target sequences can be integrated into the genome of a subject and the presence of the array results in resistance of the subject to the virus. Some embodiments of the invention include targeting a targeted virus at more than one sequence, which reduces the likelihood that a mutant virus is not cut.

Some embodiments of a multiplex nucleic acid targeting system of the invention are CRISPR-based nucleic acid targeting systems. CRISPR-based systems used in systems and methods of the invention may be DNA targeting CRISPR systems that utilize enzymes, such as Cas9 and Cas12a (formerly Cpf1). In addition, methods and systems of the invention may be used in RNA targeting CRISPR systems. RNA targeting CRISPR systems may utilize RNA targeting enzymes such as, but not limited to Cas13. Additional non-limiting examples of Cas13 enzymes that may be used in methods and systems of the invention are: Cas13a (formerly C2c2), Cas13b, Cas13c, and Cas13d. Nucleic acid targeting systems and methods of the invention permit certain nucleic acid sequences to be introduced into cells, cells lines, and organisms where they are directed to and modify one or more gene sequences. One or more of the gene sequences may be preselected gene sequences. Previous RNA-guided nucleic acid targeting elements based on the CRISPR/Cas9 nuclease have been used to introduce many types of genetic modifications into cells and organisms, including but not limited to preselected gene modifications. Methods, systems, and components of the invention can be used to increase efficacy and efficiency of nucleic acid targeting from that of previously known CRISPR methods and systems.

Designing and preparing multiplex nucleic acid targeting systems and components thereof, may include one or more of the preselection of one or more target nucleic acid sequences, which also may be referred to herein as "target genes" and/or "target genetic elements." Additional aspects of the invention comprise methods that can be used to design, identify and utilize a plurality of functional nucleic acid molecules (a non-limiting example of which is a functional gRNA molecule) that are capable of targeting one or more RNA-guided nucleic acid binding proteins such that the RNA-guided nucleic acid binding proteins bind an independently preselected nucleic acid sequence. Certain embodiments of the invention may also include selection and use of one or more detectable labels, such as fluorescent detectable labels, etc., which may be used in certain embodiments of the invention as activity reporter molecules.

CRISPR-Based Methods and Systems

Screening methods and systems of the invention and multiplex nucleic acid targeting methods and systems of the invention can be used in systems such as, but not limited to CRISPR systems. Examples of CRISPR systems in which methods and systems, and arrays of the invention may be used are CRISPR systems that utilize DNA-targeting enzymes such as Cas9 and Cas12a (previously referred to as Cpf1), and RNA-targeting Cas13 enzymes, including but not limited to: Cas13a (formerly C2c2), Cas13b, Cas13c, and Cas13d. The screening methods and systems and the multiplex nucleic acid targeting systems of the invention may comprise one or more of: guide RNAs, protein-assisted RNA cleavage/processing molecules, RNA-guided DNA-binding protein, guided DNA-binding protein endonucleases, expression cassettes, vectors, promoters, target genetic elements (e.g., target genes), etc. (see for example: Esvelt et al., Nat Methods. 2013 November; 10(11):1116-21. doi: 10.1038/nmeth.2681. Epub 2013 Sep. 29; Zetsche, B., et al., Nat Biotechnol. 2017 January; 35(1):31-34 doi: 10.1038/nbt.3737. Epub 2016 Dec. 5; Mali, P, et al., Nat Methods. 2013 October; 10(10):957-63. doi: 10.1038/nmeth.2649; and Abudayyeh, 0.0, et al. Nature Volume 550, pages 280-284 (12 Oct. 2017); the content of each of which is incorporated by reference herein in its entirety.) Certain methods for preparing and using components of a multiplex nucleic acid targeting system are known and routinely used in the art. Certain some art-known methods can be used in conjunction with methods of the invention for identifying, generating, and using improved sequences corresponding to protein-assisted RNA cleavage/processing, a non-limiting example of which are gRNA scaffold molecules as described herein. In certain embodiments of the invention methods and components of the invention can be used in systems such as, but not limited to: multiplex nucleic acid targeting systems, CRISPR-based systems, etc.

Certain embodiments of components, methods, screening methods, minimally repetitive arrays, gRNAs, sequences corresponding to protein-assisted RNA cleavage/processing, and systems of the invention can be used with CRISPR-based methods, systems, and technologies. Details of CRISPR systems such as, but not limited to, CRISPR-Cas systems and examples of their use are known in the art, see for example: Deltcheva, E. et al. Nature 471, 602-607 (2011); Gasiunas, G., et al., PNAS USA 109, E2579-2586 (2012); Jinek, M. et al. Science 337, 816-821 (2012); Sapranauskas, R. et al. Nucleic acids research 39, 9275-9282 (2011); Bhaya, D., et al., Annual review of genetics 45, 273-297 (2011); and H. Deveau et al., Journal of Bacteriology 190, 1390 (February, 2008), the content of each of which is incorporated by reference herein in its entirety.

Three classes of CRISPR systems are generally known and are referred to as Type I, Type II or Type III. According to one aspect of the invention, methods to identify and/or generate sequences corresponding to protein-assisted RNA cleavage/processing, methods to identify and/or generate gRNAs and gRNA arrays may be used in one or more of the three classes of CRISPR systems, as well in other suitable systems. Type I, II, and III CRISPR systems and their components are well known in the art. See for example, K. S. Makarova et al., Nature Reviews Microbiology 9, 467 (June, 2011); P. Horvath & R. Barrangou, Science 327, 167 (Jan. 8, 2010); H. Deveau et al., Journal of Bacteriology 190, 1390 (February, 2008); J. R. van der Ploeg, Microbiology 155, 1966 (June, 2009), the contents of each of which is incorporated by reference herein in its entirety. Bioinformatic analyses have generated extensive databases of CRISPR loci in a variety of bacteria and methods, systems, arrays, and compositions of the invention may be used in conjunction with existing and generated databases of CRISPR loci. See for example: M. Rho, et al., PLoS genetics 8, e1002441 (2012) and D. T. Pride et al., Genome Research 21, 126 (January, 2011) each of which is incorporated by reference herein in its entirety. A recently designated Type V system is similar in many aspects to Type II systems and may include a multiplex nucleic acid targeting method or system of the invention. (see for example, B. Zetsche et al., 2015, Cell 163, 1-13; T. Yamano et al., 2016, Cell, April 21 doi:10.1016/j.cell.2016.04.003; D. Dong et al., 2016, Nature, 20 April, doi:10.1038/nature17944; I. Fonfara et al., 2016, Nature, 20 April, doi:10.1038/nature17945). It will be understood that references herein to "Cas9", the RNA-guided DNA-binding protein nuclease of Type II CRISPR systems, can be replaced by "Cpf1", the RNA-guided DNA-binding protein nuclease of Type V systems or other suitable nucleic acid guided nucleic acid binding proteins. It will be understood, that certain embodiments of components, arrays, gRNAs, and systems of the invention may be used in systems utilizing targeted one or more DNA-binding nucleases rather than RNA-guided DNA-binding nucleases. For example, see Gao, F., et al., Nature Biotech online publication, May 2, 2016: doi:10.1038/nbt.3547, the content of which is incorporated herein by reference.

System Components

Aspects of the invention include methods of preparing sequences corresponding to protein-assisted RNA cleavage/processing, gRNAs, gRNA arrays, etc. that can be used in multiplex nucleic acid targeting systems. Multiplex nucleic acid targeting systems, which may be CRISPR-based systems, may be present in cells, cell lines, and/or organisms. Multiplex nucleic acid targeting system components delivered into a cell or organism can be designed, in part, using embodiments of methods of the invention. Design methods of the invention are directed to multiplex nucleic acid targeting systems comprising components that can be separately encoded as nucleic acid sequences that are delivered into the a cell or organism. Non-limiting examples of components that may be included in a multiplex nucleic acid targeting system of the invention include one or more of: guide RNAs, functional sequences corresponding to protein-assisted RNA cleavage/processing, guided DNA binding proteins, nucleic acid-guided DNA binding proteins, RNA-guided DNA binding proteins, DNA-guided DNA binding proteins, promoter/enhancer/3'UTR sequences, housekeeping gene sequences, promoter sequences, predetermined target genes, RNA molecules, DNA molecules, target genetic elements, target genes, reporter proteins and their encoding nucleic acid molecules, detectable labels and sequences encoding detectable labels, such as but not limited to fluorescent labels.

Identification and screening systems and methods of that can be utilized in a multiplex nucleic acid targeting method and/or system of the invention may, in some embodiments include identifying a target gene in the genome of a host cell or organism in which a multiplex nucleic acid targeting system will be delivered. As used herein the term "host" or "target" when used in reference to a cell, cell line, organism, or a system for multiplexing, means a cell, cell line, organism, or system, respectively that includes components for a multiplex nucleic acid targeting system of the invention. In some embodiments of the invention, a host cell is a germline cell. Some components included in embodiments of methods and systems of the invention may be "preselected" (used interchangeably herein with the term "selected")" and/or "independently selected" or "independently preselected" in reference to genes, nucleic acids, targets, etc. For example, the terms selected and preselected used in reference to a target gene, means that the target gene was chosen as a target gene. Similarly, a preselected or selected nucleic acid sequence is one that is chosen for use in a method or system of the invention. The term "independently" as used herein in reference to a component, means a component may be chosen independent of others. For example an independently preselected or independently selected nucleic acid sequence is a nucleic acid sequence that is chosen that may be the same or different than one or more other nucleic acid sequences chosen.

Sequence Variants

Components of a system of the invention may include sequences described herein, and/or may also include functional variants of such sequences. A variant polypeptide may include deletions, point mutations, truncations, amino acid substitutions and/or additions of amino acids or non-amino acid moieties, as compared to its parent polypeptide. Modifications of a polypeptide of the invention may be made by modification of the nucleic acid sequence that encodes the polypeptide. The terms "protein" and "polypeptide" are used interchangeably herein as are the terms "polynucleotide" and "nucleic acid" molecule. A nucleic acid molecule may comprise genetic material including, but not limited to: RNA, DNA, mRNA, cDNA, etc. As used herein with respect to polypeptides, proteins, or fragments thereof, and polynucleotides that encode such polypeptides the term "exogenous" means the one that has been introduced into a cell, cell line, organism, or organism strain and not naturally present in the wild-type background of the cell or organism strain.

In certain embodiments of the invention, a polypeptide or nucleic acid variant may be a polypeptide or nucleic acid, respectively that is modified from its "parent" polypeptide or nucleic acid sequence. Variant polypeptides and nucleic acids can be tested for one or more activities (e.g., delivery to a target gene, modulating transcription of a target gene, etc.) to determine which variants are possess desired functionality for use in a method or system of the invention.

The skilled artisan will also realize that conservative amino acid substitutions may be made in a polypeptide, for example in a Cas9 polypeptide, to design and construct a functional variant useful in a method or system of the invention. As used herein the term "functional variant" used in relation to polypeptides is a variant that retains a functional capability of the parent polypeptide. As used herein, a "conservative amino acid substitution" refers to an amino acid substitution that does not alter the relative charge or size characteristics of the polypeptide in which the amino acid substitution is made. Conservative substitutions of amino acids may, in some embodiments of the invention, include substitutions made amongst amino acids within the following groups: (a) M, I, L, V; (b) F, Y, W; (c) K, R, H; (d) A, G; (e) S, T; (f) Q, N; and (g) E, D. Polypeptide variants can be prepared according to methods for altering polypeptide sequence and known to one of ordinary skill in the art such. Non-limiting examples of functional variants of polypeptides for use daisy chain gene drives of the invention are functional variants of a Cas9 polypeptide, functional variants of a Cas protein, functional variants of a Cas12a protein, functional variants of reporter proteins, functional variants of a nuclease protein, etc.

As used herein the term "variant" in reference to a polynucleotide or polypeptide sequence refers to a change of 1, 2, 3, 4, 5, 6, 7, 8, 9, 10, or more nucleic acids or amino acids, respectively, in the sequence as compared to the corresponding parent sequence. For example, though not intended to be limiting, an amino acid sequence of variant reporter protein may be identical to that of its parent reporter protein sequence except that 1, 2, 3, 4, 5, 6, 7, 8, 9, 10, or more amino acid substitutions, deletions, insertions, or combinations thereof, may be present, thus making it a variant of the parent reporter protein. In another non-limiting example, the amino acid sequence of a variant Cas9 nuclease polypeptide may be identical to that of its parent Cas9 nuclease except that it has 1, 2, 3, 4, 5, 6, 7, 8, 9, 10, or more amino acid substitutions, deletions, insertions, or combinations thereof, and thus is a variant of the parent Cas9 nuclease. Certain methods of the invention for designing and constructing methods and systems of the invention include methods to prepare functional variants of components used in embodiments of screening systems and assay methods of the invention and genome-editing systems and methods of the invention. Methods provided herein, and other art-known methods can be used to prepare candidate component sequences that can be tested for function and to determine whether they retain sufficient activity for use in a system of method of the invention.

Methods of the invention provide means to test for activity and function of variant sequences and to determine whether a variant is a functional variant and is suitable for inclusion in a screening method and/or a multiplex method and/or system of the invention. Suitability can, in some aspects of methods of the invention, be based on one or more characteristics such as: expression; cell localization; gene-cutting activity, efficacy in modulating activity of a target gene, etc. Functional variant polypeptides and functional variant polynucleotides that may be used in methods and systems of the invention may be amino acid and nucleic acid sequences that have at least 80%, 81%, 82%, 83%, 84%, 85%, 86%, 87%, 88%, 89%, 90%, 91%, 92%, 93%, 94%, 95%, 96%, 97%, 98%, or 99% identity to their parent amino acid or nucleic acid sequence, respectively.

Art-known methods can be used to assess relative sequence identity between two amino acid or nucleic acid sequences. For example, two sequences may be aligned for optimal comparison purposes, and the amino acid residues or nucleic acids at corresponding positions can be compared. When a position in one sequence is occupied by the same amino acid residue, or nucleic acid as the corresponding position in the other sequence, then the molecules have identity/similarity at that position. The percent identity or percent similarity between the two sequences is a function of the number of identical positions shared by the sequences (i.e., % identity or % similarity=number of identical positions/total number of positions×100). Such an alignment can be performed using any one of a number of well-known computer algorithms designed and used in the art for such a purpose. It will be understood that a variant polypeptide or polynucleotide sequence may be shorter or longer than their parent polypeptide and polynucleotide sequence, respectively. The term "identity" as used herein in reference to comparisons between sequences may also be referred to as "homology".

Preparation and Delivery

Components included in embodiments of methods and systems of the invention may be delivered into a cell using standard molecular biology techniques. In certain aspects of the invention, vectors are used to deliver components into a cell for use in a function screening system or method; a processing screening system or method; and a multiplex nucleic acid targeting system or method of the invention For example, in an embodiment of a function-screening system of the invention, a vector may be used to deliver into a cell a sequencing encoding one or more of: a nucleic acid sequence encoding a protein capable of binding a promoter sequence that is capable of driving expression of a reporter protein; a nucleic acid sequence encoding a Cas protein capable of binding a promoter sequence that is capable of driving expression of a reporter protein; a nucleic acid sequence encoding a Cas12a protein capable of binding a promoter sequence that is capable of driving expression of a reporter protein; a Cas12a ortholog capable of binding a promoter sequence that is capable of driving expression of a reporter protein; a nucleic acid molecule comprising the promoter sequence and the sequence encoding the reporter protein; and one or a plurality of nucleic acid molecule fragments, wherein the binding of one the nucleic acid molecule fragments to a Cas protein (non-limiting examples of which are: a Cas protein, a Cas12a protein, a Cas12a protein, AsCas12A (wild type), LbCas12a, LbCas12a(RR), and enAsCas12a) produces a riboprotein complex. As used herein, the term "vector" used in reference to delivery of components of a system of the invention and/or components used in a method of the invention refers to a polynucleotide molecule capable of transporting between different genetic environments another nucleic acid to which it has been operatively linked. One type of vector is an episome, i.e., a nucleic acid molecule capable of extra-chromosomal replication. Some useful vectors are those capable of autonomous replication and/or expression of nucleic acids to which they are linked. Vectors capable of directing the expression of genes to which they are operatively linked may be referred to herein as "expression vectors". Other useful vectors, include, but are not limited to viruses such as lentiviruses, retroviruses, adenoviruses, and phages. Vectors useful in some methods of the invention can genetically insert one or more of components into a dividing or a non-dividing cell and can insert one or more components as described herein into an in vivo or in vitro cell.

Vectors useful in methods of the invention may include sequences including, but not limited to one or more promoter sequences, enhancer sequences, 3' untranslated region (3'UTR) sequences, guide nucleic acid sequences, gRNA sequences, gRNA arrays, DNA binding protein encoding sequences, reporter proteins and their encoding nucleic acid molecules, detectable label encoding sequences, etc. Methods of the invention can be used to design and construct vectors comprising components suitable for inclusion in an embodiment of a system of method of the invention, including screening methods and systems, and multiplex nucleic acid targeting methods and systems. Expression vectors and methods of their use are well known in the art.

Promoters that may be used in methods and vectors of the invention include, but are not limited to, cell-specific promoters or general promoters. Methods for selecting and using cell-specific promoters and general promoters are well known in the art. In some embodiments of screening methods and systems of the invention, a promoter is a constitutive promoter.

Synthesis of RNA sequences and/or DNA sequences for use in a method or system of the invention can be done using art-known methods or the sequences can be obtained from commercial entities familiar with relevant arts, such as, but not limited to: Integrated DNA Technologies gBlocks (Integrated DNA Technologies, Coralville, Iowa) and ThermoFisher GeneArt Strings (Thermo Fisher Scientific).

Cells and Organisms

One or more methods and systems of the invention for identifying and screening gRNA scaffolds and using selected identified gRNA scaffolds in multiplex nucleic acid targeting systems and methods, can be carried out in a host cell or organism. A host cell or organism is one to which components of a method or system of the invention are delivered and in which a method of the invention is then carried out. In some aspects of the invention a host cell is outside an organism. In some embodiments a host cell is in an organism. Systems of the invention may be delivered into cells and organisms at various developmental stages of the cells and organisms, respectively. Non-limiting examples of stages of cells to which components of a system of the invention may be delivered or included are: embryonic cells, germline cells, gametes, cells that can give rise to a gamete, zygotes, pre-meiotic cells, post-meiotic cells, fully-differentiated cells, and mature cells. Cells at these stages may be isolated cells, cells in cell lines, cells in cell, tissue, or organ culture, cells that are within an organism. In certain embodiments of the invention, components of a system of the invention, or for use in a method of the invention are delivered into a cell and the cell is delivered into an organism.

Components and systems of the invention may be delivered to and included in cells of various organisms. In some aspects of the invention, a cell or organism is a vertebrate or an invertebrate cell or organism. In certain aspects of the invention, a cell or organism is a eukaryotic or prokaryotic cell or organism. Non-limiting examples of organisms in which a system of the invention can be delivered and/or utilized are: insects, fish, reptiles, amphibians, mammals, (horses, mice, non-human primates, humans, dogs, cats, etc.) birds, protozoa, annelids, mollusks, echinoderms, flatworms, coelenterates, and arthropods, including arachnids, crustaceans, insects, and myriapods. IN some aspects of the invention, methods and systems described herein can be used in human health-care practice as well as in veterinary practice.

In some aspects of the invention an organism selected for inclusion of a system or method of the invention is selected because of a population of the organism that is of interest to modify in a manner to benefit or otherwise change the organism. For example, though not meant to be limiting, multiplex nucleic acid targeting methods of the invention can be used in a mammal in order to confer resistance to a virus to that animal. As a non-limiting example, if it is of interest to protect against a viral infection in a pig, one or more methods of the invention can be used to generate and deliver components comprising a gRNA scaffold array of the invention and a suitable multiplex nucleic acid targeting system into the pig and used to increase immunity of the pig to the virus. In certain aspects of the invention, an organism species to which a multiplex nucleic acid targeting system or method may be delivered to, or included in, is a species that serves as a vector for disease affecting humans, animals, or plants. In certain aspects of the invention, targeting many different sequences throughout the viral genome prevents the virus from evolving to evade the defense by requiring it to acquire so many mutations at once, in a manner analogous to the way that "cocktail" therapies including multiple inhibitory small molecules inhibit the evolution of resistant pathogens.

Design, Construction, and Use

It is possible to use embodiments of multiplex nucleic acid targeting systems and methods of the invention in combination with known CRISPR-based technology. Use of methods, systems, and identified compounds of the invention permits targeting a plurality of preselected nucleic acid sequences in cells and organisms by using a gRNA array of the invention. Methods, systems, and identified gRNA scaffolds of the invention can be used to attain numerous different goals, non-limiting examples of which are: to address biological questions, to protect organisms from viral infections and other diseases, and to identify one or more sets of set of variants with differing activities for tunable gene repression in organisms, including but not limited to bacteria.

The following examples are provided to illustrate specific instances of the practice of the present invention and are not intended to limit the scope of the invention. As will be apparent to one of ordinary skill in the art, the present invention will find application in a variety of compositions and methods.

EXAMPLES

Example 1

Design of DNA Binding Circuit Systems and Library Construction

A DNA binding circuit system uses a nuclease-dead Cas enzyme and a gRNA to target a constitutive promoter driving a reporter, with the goal of identification of functional gRNA scaffolds. The DNA binding circuit described herein uses dLbCas12a to target a constitutive bacterial promoter driving a red fluorescent protein. DNA binding resulting in reduced fluorescent signal is a proxy for target cleavage by an equivalent nuclease-active enzyme. Expression of dLbCas12a and guide RNA can be independently controlled by the small molecules anhydrotetracycline and vanillic acid.

Materials and Methods
Design of DNA Binding Circuit

A DNA binding circuit system uses a nuclease-dead Cas enzyme and a gRNA to target a constitutive promoter driving a reporter, with the goal of identification of functional gRNA scaffolds. The DNA binding circuit described herein uses dLbCas12a to target a constitutive bacterial promoter driving a red fluorescent protein. All components of the circuit are encoded on a single plasmid, which includes 1) a bacterial origin of replication, 2) constitutively expressed repressor proteins that repress promoters in the absence of either aTc (Tet Repressor [TetR]) or Vanillic Acid (Van Repressor [VanR]), 3) a promoter driving gRNA which contains Van Operator sites that are bound by VanR in the absence of vanillic acid—in the presence of vanillic acid the promoter drives expression of gRNA, 4) a promoter driving dLbCas12a(RR) which contains Tet Operator sites that are bound by TetR in the absence of a tetracycline analogue such as aTc—in the presence of aTc the promoter drives expression of dLbCas12a(RR), 5) a strong constitutive promoter driving a red fluorescent protein, 6) a gRNA sequence driven by the VanA promoter in (3) whose spacer sequence is complementary to part of the promoter sequence in (5).

DNA binding resulting in reduced fluorescent signal is a proxy for target cleavage by an equivalent nuclease-active enzyme. Expression of dLbCas12a and guide RNA can be independently controlled by the small molecules anhydrotetracycline and vanillic acid.

Optimization of Screen

Optimal expression levels to maximize the signal resulting from RFP expression are determined by inducing with various concentrations of each small molecule and measuring the difference in fluorescence between cells in which the guide RNA matches the RFP promoter and negative control cells in which the guide RNA does not match the RFP promoter. The induction condition for which the fold difference in RFP signal is greatest is used for subsequent assays.

Optimal induction of gRNA and dLbCas12a(RR) expression was determined using a circuit encoding a gRNA with the WT scaffold. Both inducers, aTc and VanA, were titrated against one another and the RFP signal was measured by flow cytometry for each condition. Mean/median fluorescence was compared to two types of controls: 1) a circuit expressing a gRNA with a random scaffold (non-functional) and 2) a cell population expressing no fluorescent protein. Optimal inducer concentrations were chosen based on the condition that gave us the largest fold difference between the circuit encoding WT gRNA and the circuit encoding random scaffold gRNA while allowing the cells to maintain a growth rate >~70% of that of cells where dLbCas12a(RR) and gRNA were not induced (grown without aTc and without VanA).

Design of Insert Library

In some experiments, a wild-type LbCas12a gRNA scaffold was 21 nt long and formed a characteristic hairpin with a 5-basepair stem and a 5-nucleotide loop. Variants of the WT LbCas12a gRNA scaffold were designed with either single-site degeneracy (1 nt different than WT), pairwise degeneracy (2 nt different than WT), or "fully" degenerate (4, 5, and 6-nt loops with the wild type stem or with 1 of 3 mutant stems). Library sequences were ordered from a commercial supplier and amplified via microarray synthesis. Libraries were ordered from a commercial synthesizer and one library was ordered as individual oligos with site-specific degeneracies. For a second library the synthesizer used microarray synthesis. In both cases, the synthesized library was synthesized oligo library by PCR.

Generate Plasmid Library

The amplified insert library was cloned into the scaffold expression vector using the Golden Gate cloning system and transformed into E. coli.

Binding Circuit Experiments

Figure 3A:
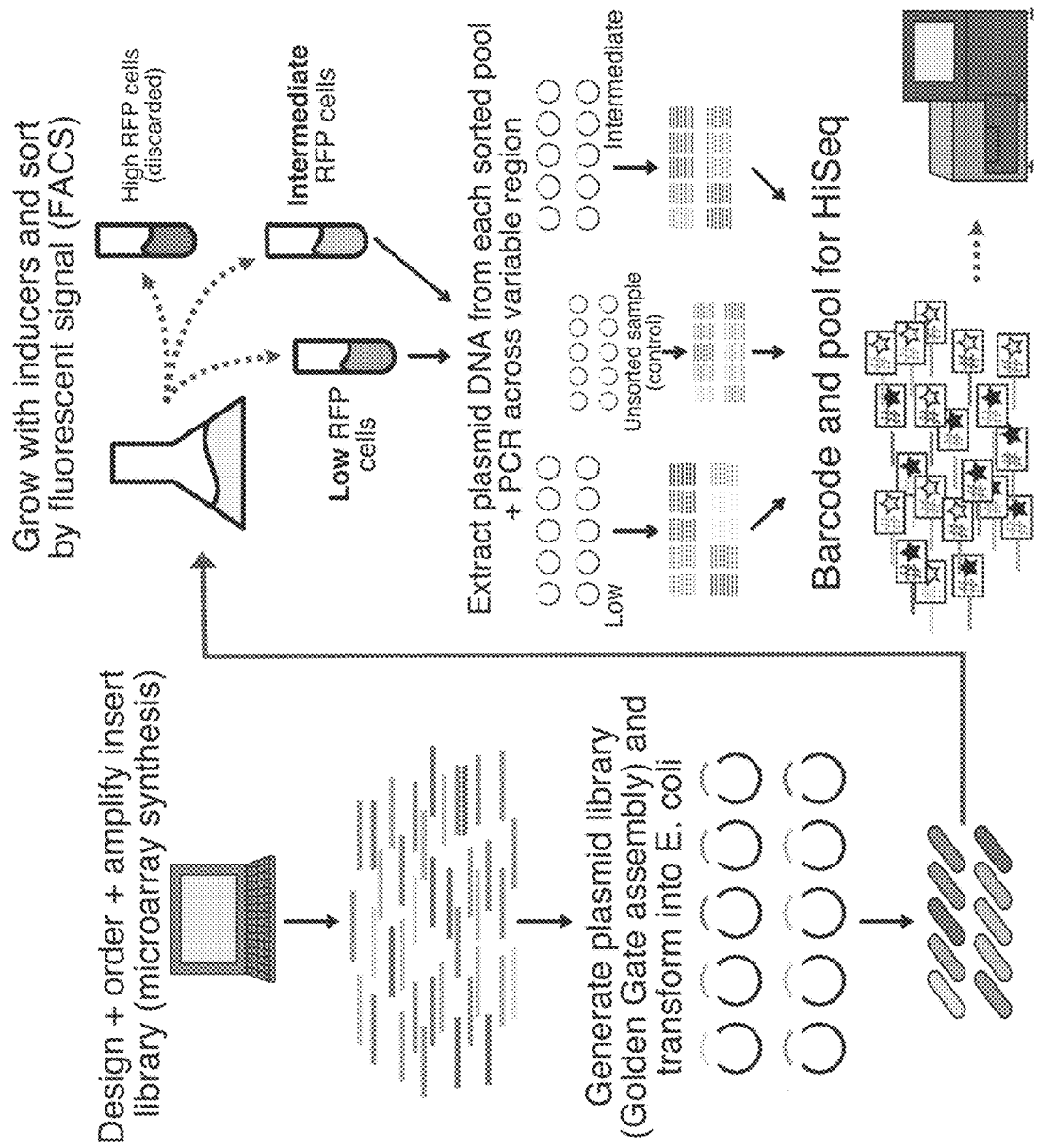
FIG. 3A-B presents a schematic diagram of the DNA binding circuit system screening workflow (FIG. 3A) and a graph of a FACS analysis of an RR dLbCas12a scaffold library grown with and without inducers (FIG. 3B). The graph in FIG. 3B illustrates that the pool of cells with high RFP expression (High RFP) is discarded because high RFP expression following induction can be difficult to distinguish from background fluorescence. RFP is red fluorescent protein.
Figure 3B:
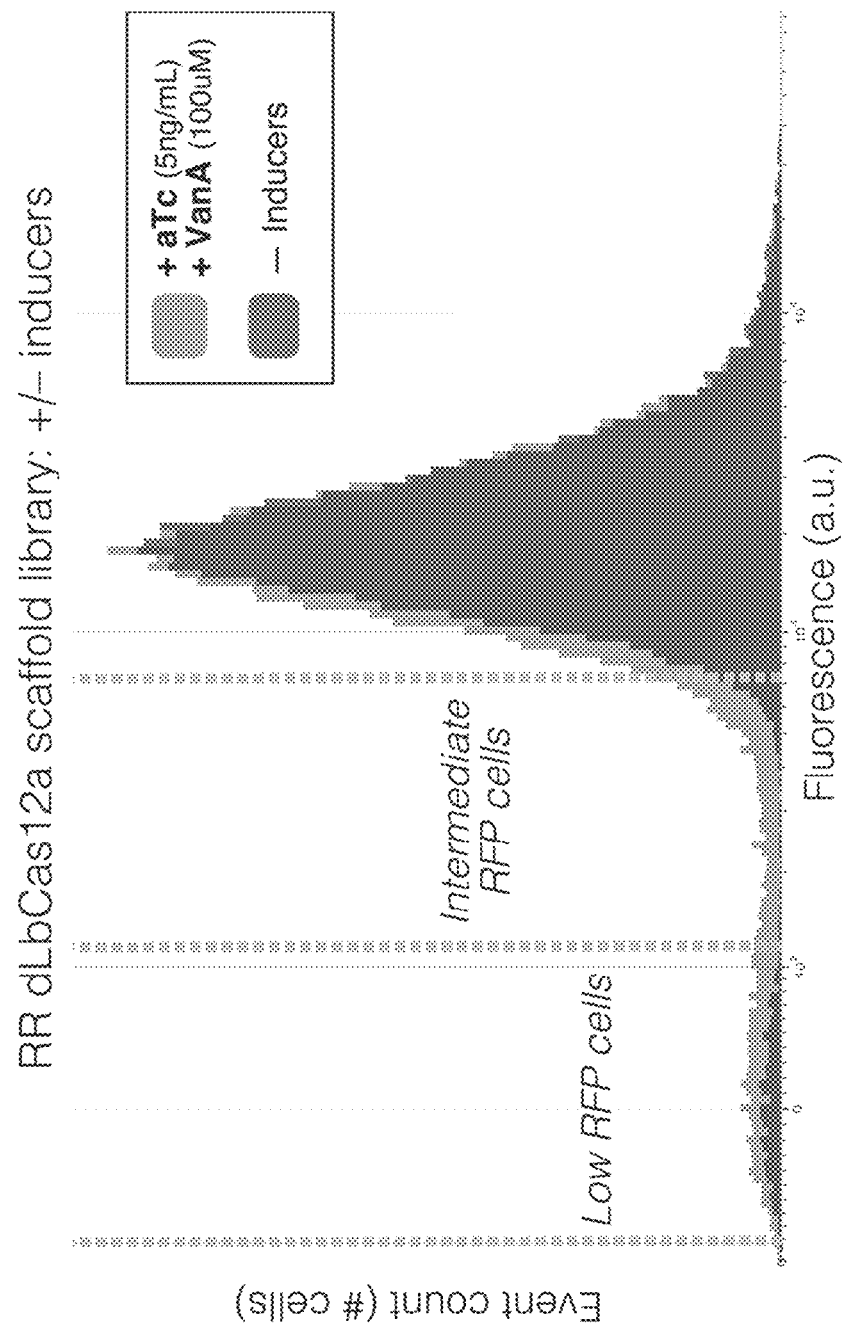

The cultures were grown with the appropriate inducers (vanillic acid and aTc), and were sorted into 3 pools—High, Intermediate, and Low—according to the intensity of their respective fluorescent signal using FACS. The pool of High RFP cells was discarded; unsorted cells from each culture were pooled into the unsorted sample control (FIG. 3A-B).

Extraction, Processing, and Sequencing Analysis

Plasmid DNA was extracted from the Intermediate, Low, and unsorted sample control pools and the region containing the variant scaffold sequence insert was amplified. Amplification products were barcoded and pooled for HiSeq analysis.

Data Analysis

To analyze scaffold performance relative to site-specific degeneracy, enrichment scores for each unique scaffold sequence were calculated based on the fractional number of HiSeq reads for that variant in the FACS-sorted RFP Low or Intermediate pools compared to the reads from the same sample before sorting. Enrichment scores were calculated as follows:

$$\frac{\text{\# reads of variant } X \text{ in sorted pool}}{\text{Total \# reads in sorted pool}} - \frac{\text{\# reads of variant } X \text{ in unsorted sample}}{\text{total \# reads in unsorted sample}} \quad \text{Equation 1}$$

Figure 4A:
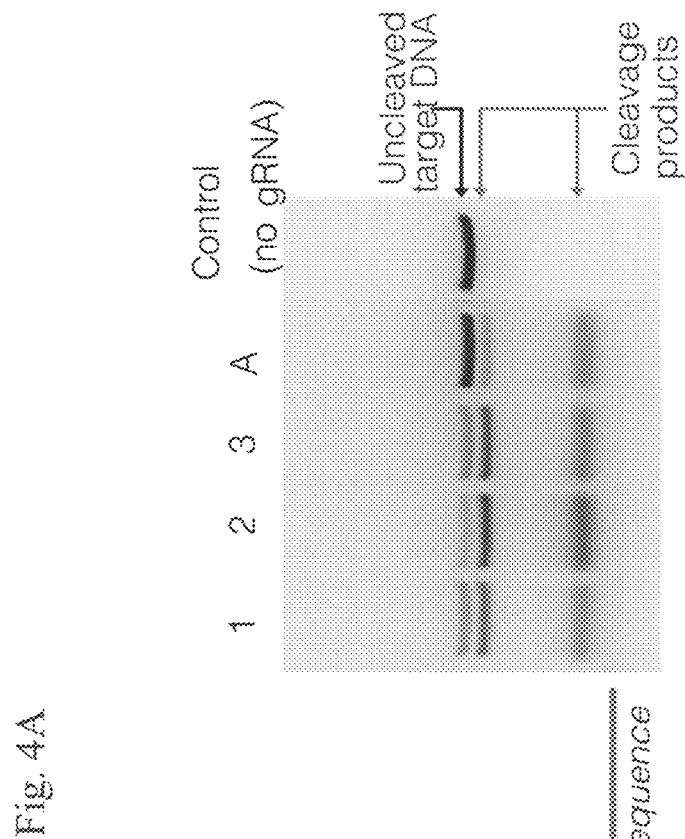
Figure 4A:
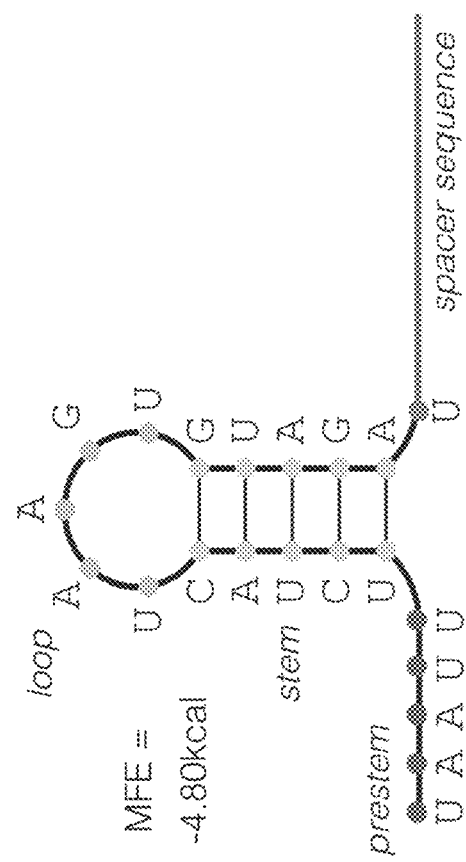

Additional assays were performed including in vitro DNA cleavage assays, which were done to confirm the selected variant scaffolds' efficacy in the presence of a functional LbCas12a nuclease (FIG. 4A).

Results and Discussion

Induction of variant gRNA scaffolds and dLbCas12a led to a substantial decrease in RFP signal (FIG. 2B-C), illustrating that CRISPR-based gene circuits can enable functional screens of gRNA efficiency and efficacy based on a measurable output.

Experiments using in vitro DNA cleavage assays confirmed that DNA binding screens enriched for highly active scaffolds (FIG. 4A). The scaffold variants in lanes 1, 2, and 3 were the most highly enriched gRNA scaffolds across 5 replicates in a DNA binding screen with the broad-specificity PAM mutant of LbCas12a (RR LbCas12a; Gao et al., 2017). Scaffold A was a very minorly enriched scaffold variant with the same loop as Scaffold 1 and showed notably lower activity in DNA cleavage assays.

The wild-type LbCas12a gRNA scaffold forms a characteristic hairpin with a 5-basepair stem and a 5-nt loop. Analysis of site-specific degeneracy revealed regions of the scaffold that are more and less permissive to mutation and pointed to key characteristics in determining scaffold function. Enrichment scores for variants with single-site degeneracy revealed that the loop is especially permissive to variation, except at the 1st position, which must be a U (FIG. 4B).

As shown in FIG. 4C, screening variants with pairwise degeneracy in the stem revealed that the wild-type UAUAC stem is highly enriched as expected. Variants with pairwise degeneracy in the stem showed strong enrichment for base pairing. The 1st and 3rd pairs of the stem tolerated U-G wobble pairing. Interestingly, C-G and G-C pairs at the 4th position were enriched over the wildtype A-U pair.

Figure 4D:
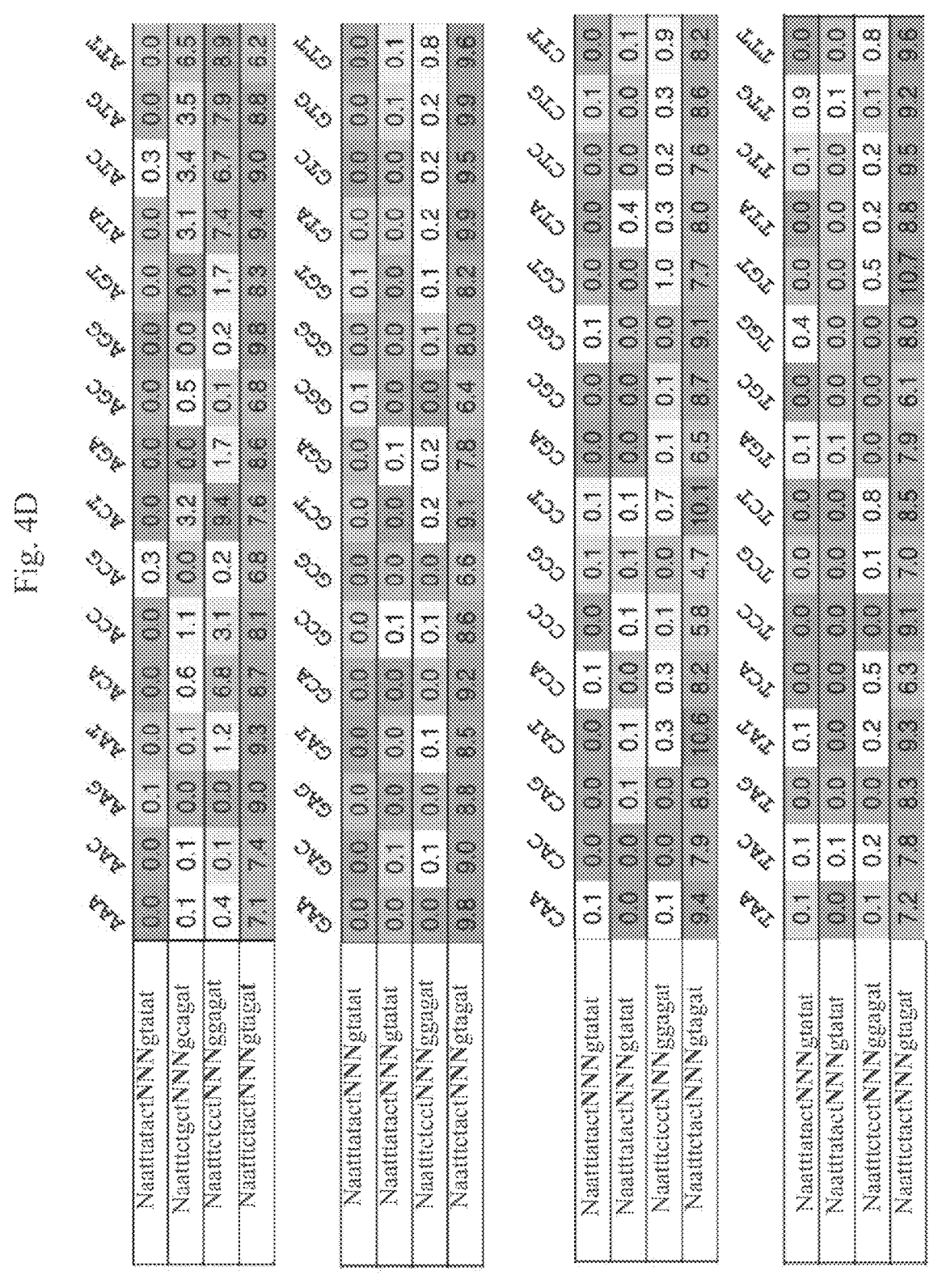

The library included fully degenerate 4, 5, and 6-nt loops. These loops were paired with 3 mutant stems proven to be active for DNA cleavage in vitro. Mean enrichment scores across 4-nucleotide loops beginning with U revealed the wild-type stem to be highly active with many UNNN loop variations, whereas mutant stems were constrained in the loops they tolerate: the UCUCC and UCUGC stem mutants showed the highest activity primarily with UAUN and UACH loops (FIG. 4D). The DNA sequences encoding functional RNA guides identified through the DNA-binding system are listed in FIG. 4E.

Binding circuit system experiments as described in Example 1 were successfully performed using four different endonucleases and a library of sequences encoding gRNA scaffolds: WT LbCas12a, RR LbCas12a, WT AsCas12a, and enAsCas12a. The procedures described in Example 1 and results shown in FIGS. 2B-C and FIGS. 4A-E are representative of binding circuit system operation and output using each of the four endonucleases.

Example 2

Guide RNA Processing Circuit Design

Figure 5A:
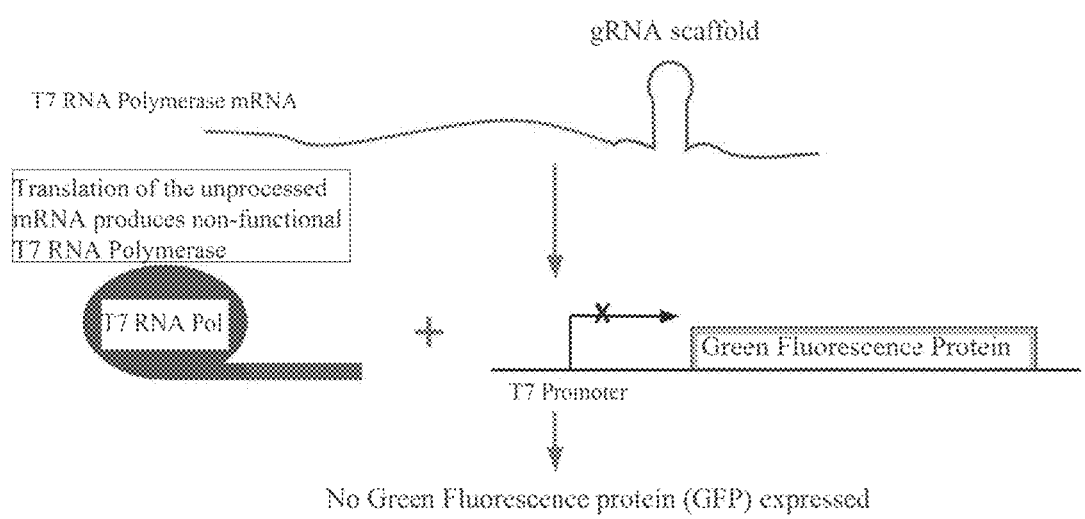
FIG. 5A-C presents schematic diagrams and a graph of the results of a gRNA processing circuit designed to exploit the fact that T7 RNA Polymerase does not tolerate C-terminal extensions. The schematics of FIG. 5A-B illustrate that an mRNA containing both the T7 mRNA sequence and a gRNA scaffold sequence at its 3' end (T7-gRNA mRNA) must be processed by Cas12a in order to produce a functional T7 RNAP, which in turn drives GFP expression. Translation in the absence of gRNA processing results in a non-functional T7 polymerase and no GFP signal.
Figure 5A:
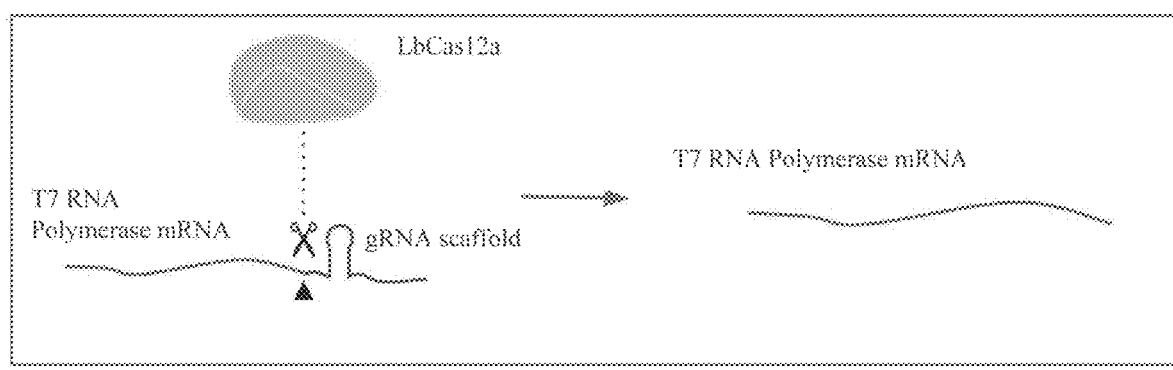
Figure 5B:
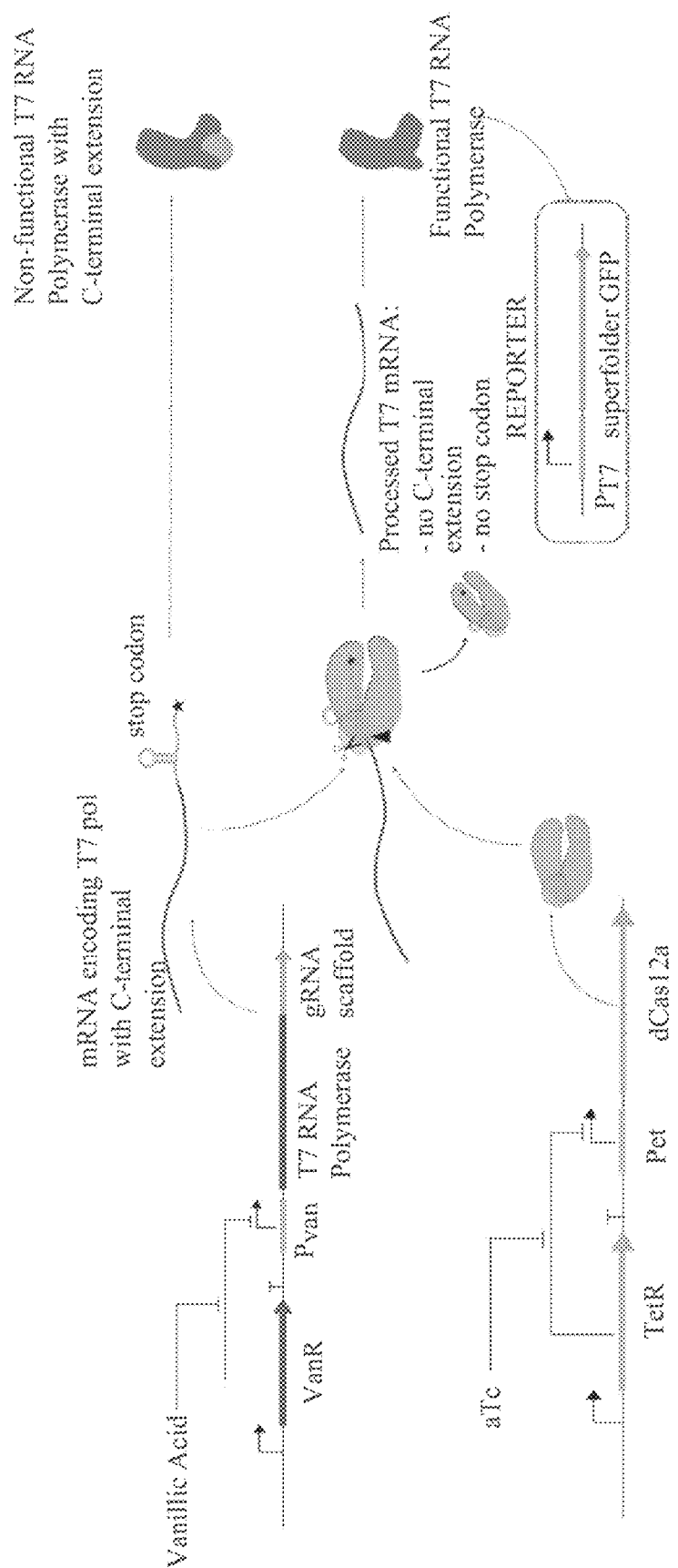

An in vitro RNA processing assay was utilized to assess function of identified gRNA molecules. This gRNA Processing Circuit relies on the fact that T7 RNA Polymerase does not tolerate C-terminal extensions. T7 mRNA with a gRNA scaffold at the 3' end (T7-gRNA) must be processed by Cas12a in order to produce a functional T7 RNAP, which in turn drives GFP expression (FIG. 5B).

Materials and Methods

Figure 6A:
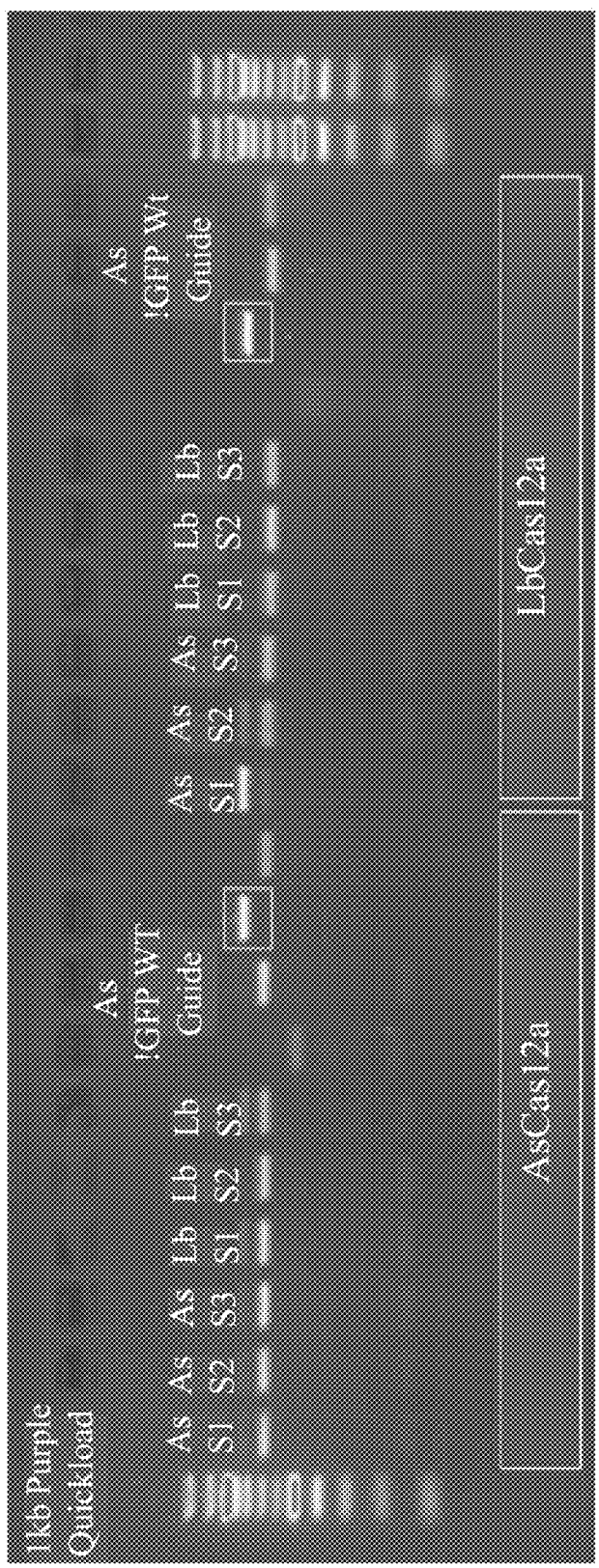
FIG. 6A-B presents photomicrographic images of a DNA cleavage gel (FIG. 6A) and an RNA cleavage gel (FIG. 6B). The DNA cleavage gel shown in FIG. 6A depicts the cleavage of DNA targets after incubation with a riboprotein complex comprising AsCas12a or LbCas12a protein and a gRNA scaffold containing either As or Lb loop sequences. The RNA cleavage gel in FIG. 6B shows the results of target processing by various variant gRNA scaffolds after incubation with AsCas12a or LbCas12a protein. MR020: WT AsCas12a Prelim and Repeat, !YFP3; MR022: WT LbCas12a Prelim and Repeat, !YFP3; and MR024: Nupack Optimized WT LbCas12a Prelim and Repeat, !YFP3.
Figure 6B:
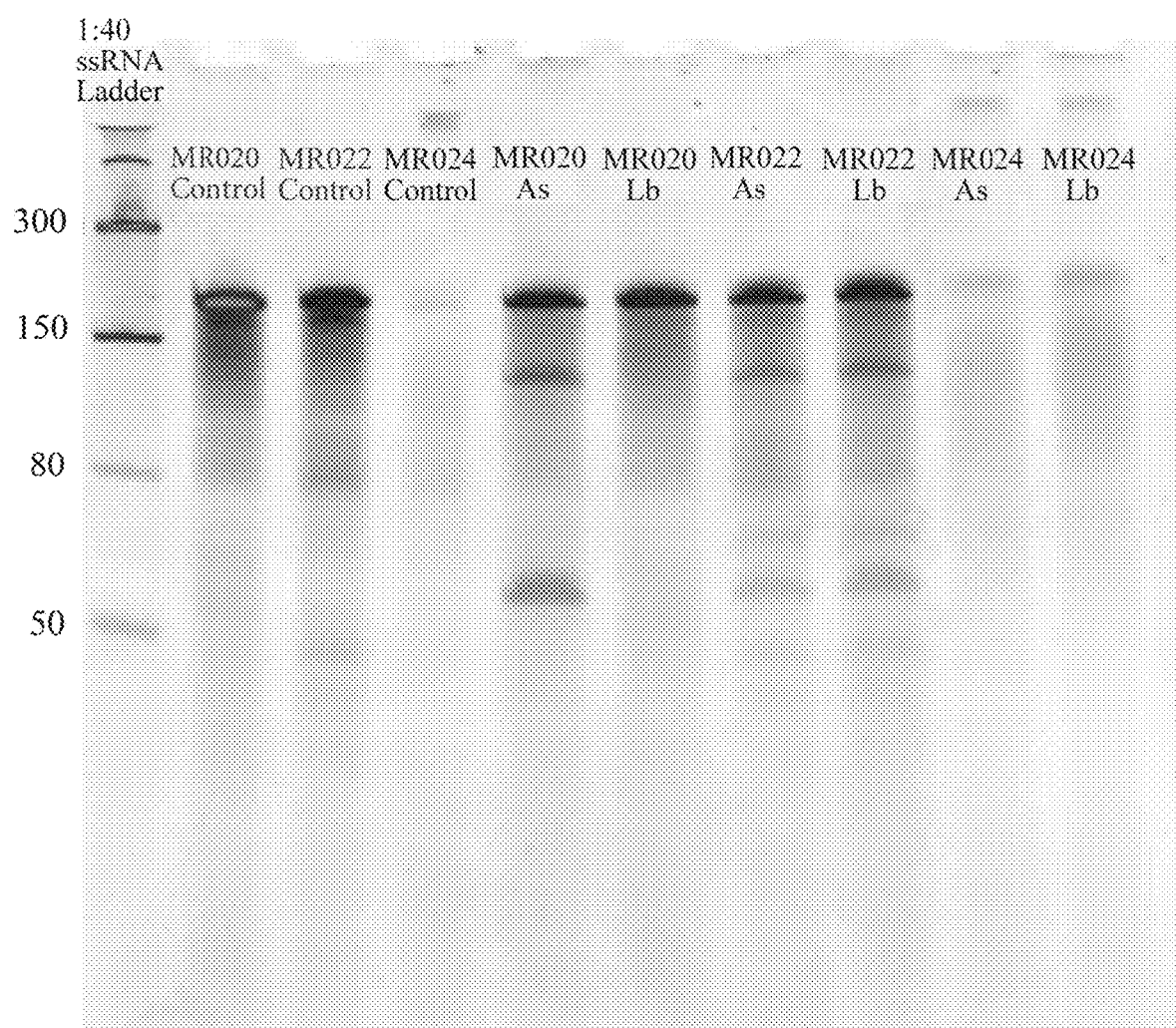

Most materials and methods were similar to those used in Example 1, with several exceptions. The measurable output of a functional variant gRNA scaffold was increased fluorescence due to the production of functional polymerase. An RNA processing assay was also used to confirm identified functional variants (FIG. 6B, FIG. 8B).

Results and Discussion

Figure 5C:
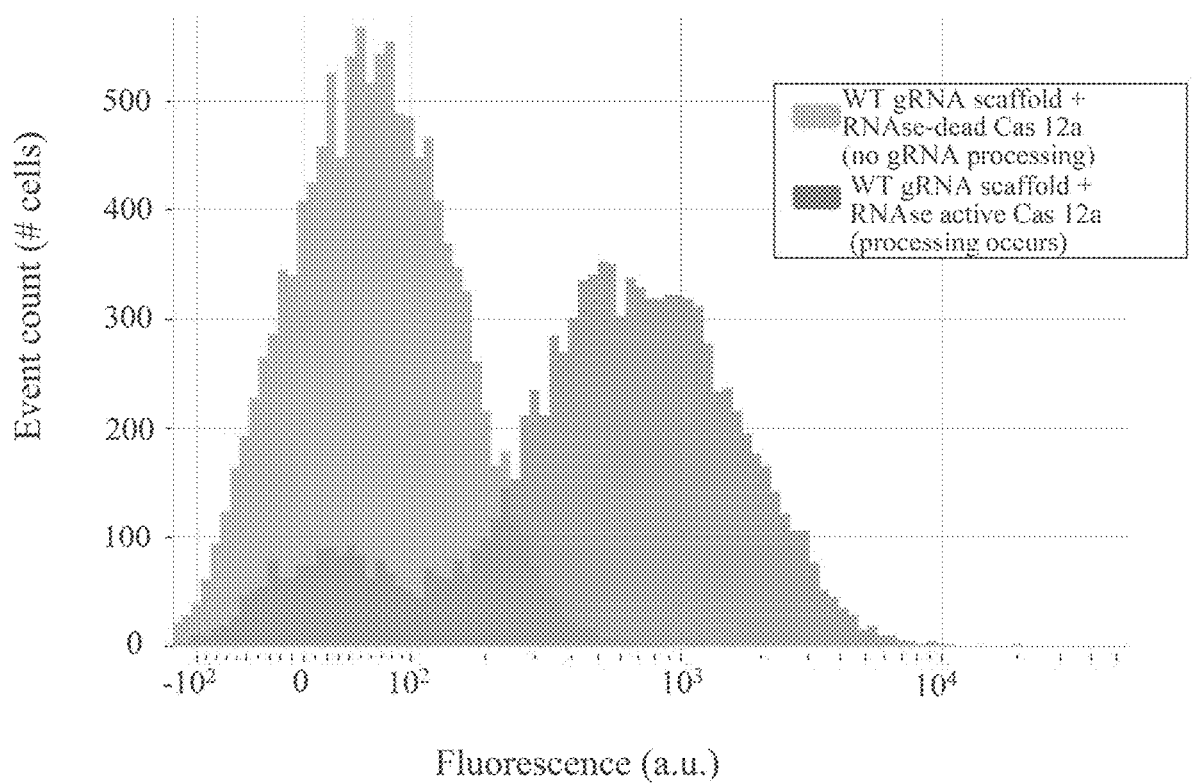
Figure 8C:
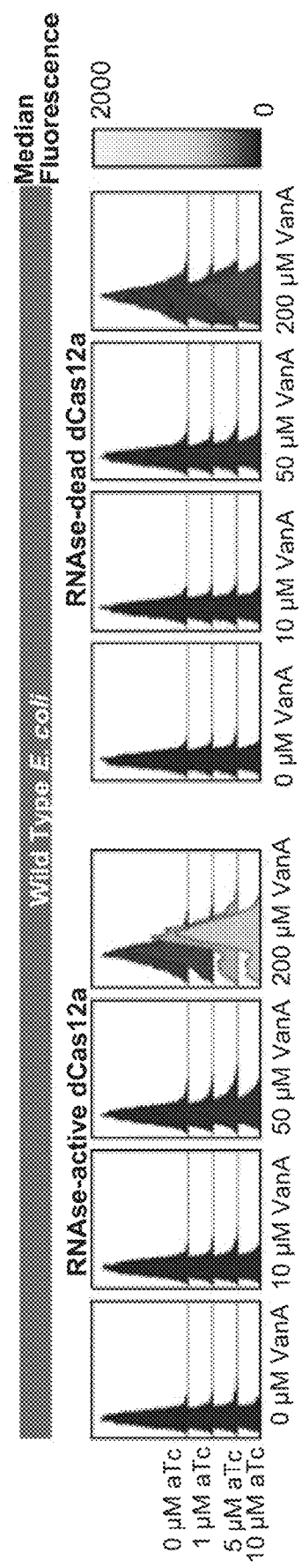
Figure 8D:
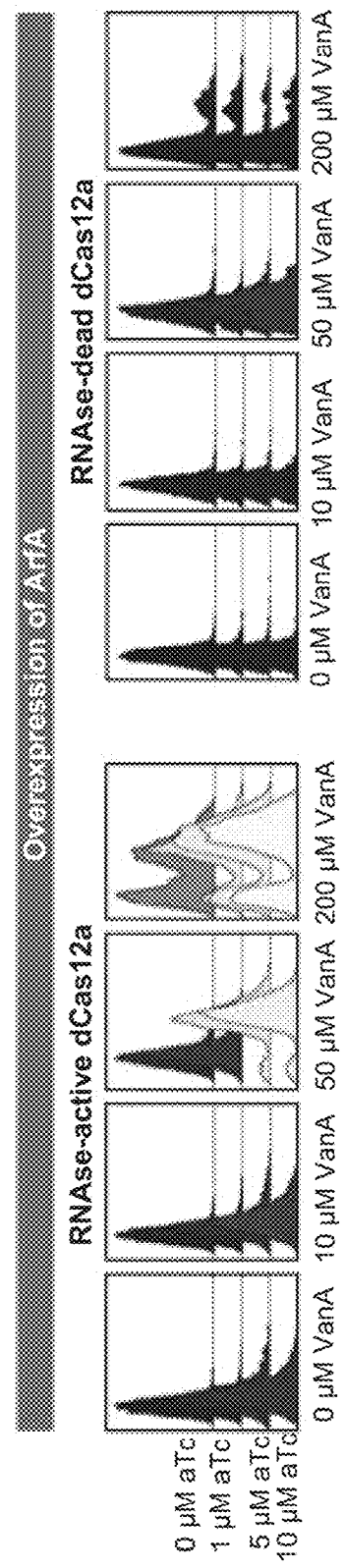

Translation in the absence of successful gRNA processing resulted in a non-functional T7 polymerase and no GFP signal (FIG. 5C). In contrast, successful gRNA processing results in functional T7 polymerase and a GFP signal (FIG. 8C). To increase the amount of functional T7 RNA polymerase produced by successful processing, the release factor ArfA was required to liberate translated polypeptides from a truncated mRNA lacking a stop codon was overexpressed (FIG. 8D). Certain top-performing gRNA scaffolds for enAsCas12a are shown in Table 2; for LbCas12a(RR) shown in Table 3; for WT AsCas12a shown in Table 4, and for WT LbCas12a shown in Table 5. These gRNA scaffolds were top performers because they had activity in both the assay described in Example 1 and in the RNA processing assay described in Example 2. Consensus sequences for the gRNA scaffolds are shown inTtables 6-13.

Example 3

Using CRISPR-Based Genetic Circuits to Develop Virus-Resistant Cell Lines or Organisms.

An application of CRISPR-based genetic circuits for screening gRNA scaffold permutations and driving robust multiplex targeting is described. The benefit of a high level of multiplexing is that targeted viruses must acquire mutations at every sequence effectively targeted for cutting by the nuclease to become immune, which becomes exponentially more difficult with the number of targeted sites.

Materials and Methods

Target Virus Identification

One or more target viruses are identified based on the environmental and economic impact on a host species of interest. For the swine industry, the two most economically important viruses are African Swine Fever Virus (ASFV) and Suid alphaherpesvirus 1(SuHV1).

Identification of Viral Target Site(s)

Available sequence data are used to identify conserved and functionally important sequences within the target virus(es). Viral genomes can be accessed through public NCBI databases. For ASFV, the NCBI genome database contains 37 complete genome assemblies from different ASFV strains. Viral genomes can be analyzed with multiple genome alignment tools such as MAFFT (Katoh and Standley 2013), and predictive software is used to identify target sites within conserved sequences with few off-targets and optimal secondary structures. (Examples of multiple sequence alignment software packages can be found at //en.wikipedia.org/wiki/List_of_sequence_alignment_software; example prediction software for Cas12a activity are CINDEL at//big.hanyang.ac.kr/cindel and CRISPR-DT at bioinfolab.miamioh.edu/CRISPR-DT) These target sites and guide RNAs can be tested through cell-free (in vitro) DNA cleavage and RNA processing assays (as performed in Examples 1-2) to validate the guides, as shown in FIGS. 6A-B. The number of guides expressed per virus targeted may vary based on a variety of factors, including but not limited to cell type, tissue type, virus type, and the target sequences within the virus. Computational modeling with Nupack (California Institute of Technology, Pasadena, CA, see nupak.org) or similar software may be used to balance rates of gRNA processing, target DNA cleavage, and the evolutionary stability of the guides.

A locus of insertion is identified that permits expression in all tissues infected by the target virus. Transgenes have been successfully expressed in pigs using the Rosa26 locus, which has been widely used in murine models of gene editing. Because ASFV infects macrophages and monocytes in the pig, it is studied in those cell lines (Sanchez et al. 2017, Kong et al. 2014, Li et al. 2014).

Promoters corresponding to high levels of expression in all tissues are identified, ideally in the desired locus of insertion. For example, the EF1a promoter is used for nuclease expression. This promoter has been previously used for ubiquitous transgene expression in the Rosa26 locus of pigs (Kong et al. 2014). Alternatively, the native ROSA26 expression is used for the nuclease, in which case EF1a is used for expression of a guide RNA array, or vice versa.

Determine Identity and Intracellular Location of Nuclease to be Used for Viral Targeting An appropriate CRISPR nuclease is chosen based on the form of the virus. For example, ASFV is targeted with Cas12a because the ASFV genome is comprised of dsDNA; however certain riboviruses are targeted with RNA-guided RNA-targeting enzyme such as Cas13d. The appropriate CRISPR nuclease must also be expressed in and/or directed to appropriate intracellular locations for targeting the virus of interest—either nuclear or cytoplasmic or both. ASFV is preferably targeted in the cytoplasm because that is where it is primarily found. CRISPR nuclease expression cassettes are preferably designed using a strong promoter found in the relevant tissue type.

Guide RNA Array Design

Figure 7A:
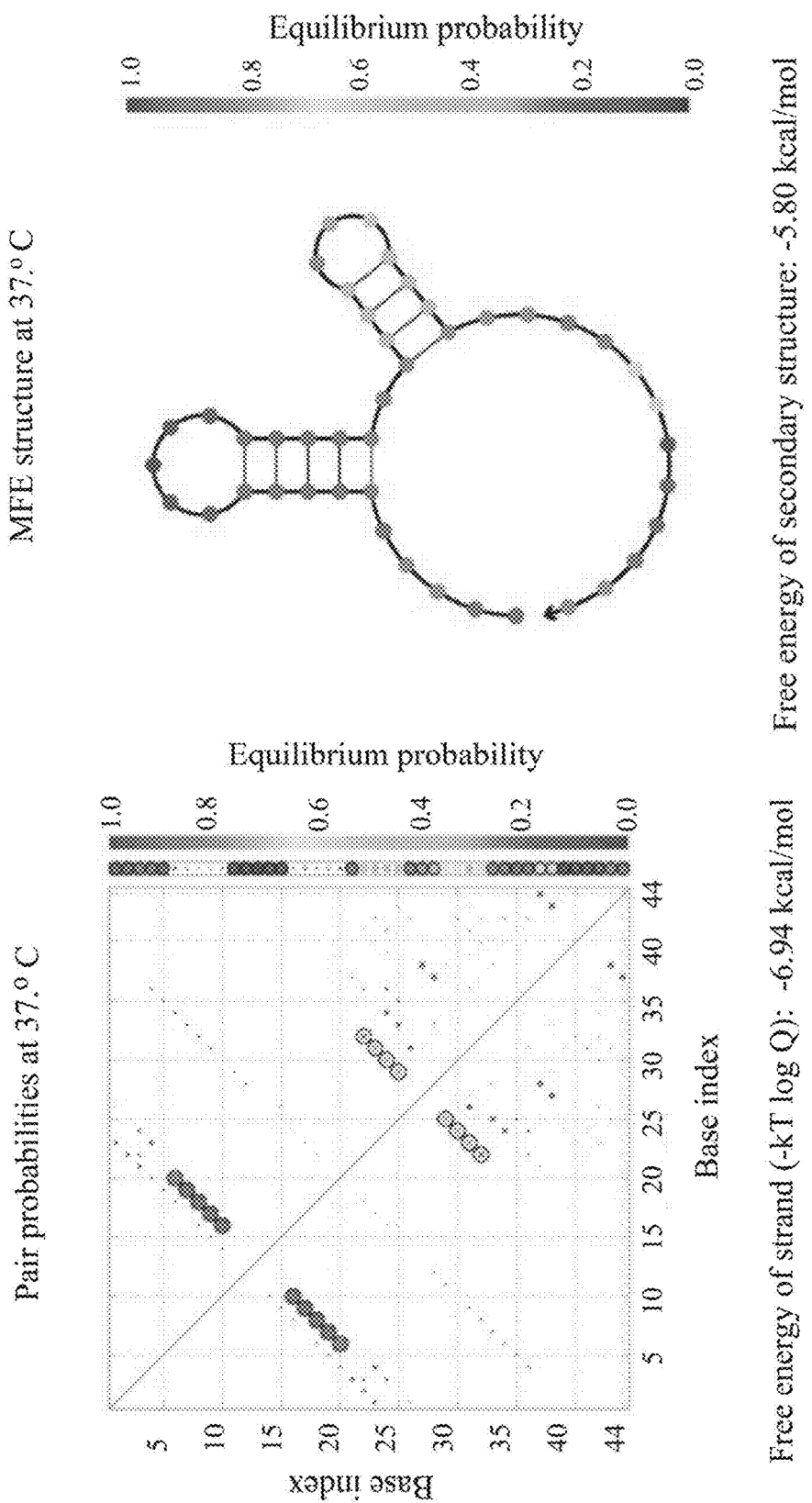

The secondary structure of the guide RNA array is carefully optimized. Repeats are paired with spacers such that secondary structure interactions between the repeat and spacer are minimized (FIGS. 7A-B) in order to promote processing of the RNA array and the formation of the guide-nuclease complex.

The maximum number of guides that can be expressed from each promoter is experimentally determined using a VPR transcriptional activation via fluorescent reporter assay. Alternatively, a series of active Pol III promoters is used to express smaller arrays (e.g., 5 guides). For ASFV, arrays of 5 guides are built, each under the U6 and 7SK promoters for small RNA expression (Chen et al. 2012). These smaller arrays are compared against an array of 10 guides under the EF1a promoter (Petkov, Hyttel, and Niemann 2013). DNA constructs for nuclease expression and RNA guide array are assembled using common DNA synthesis and cloning techniques.

Generation of Cell Lines

The nuclease and guide constructs are integrated into the cell lines or tissue through insertion at the relevant locus or through preliminary insertion through lentiviral integration. These cell lines are validated through the use of assays such as western blot, fluorescence cytometry, and qPCR. For ASFV and SuHV1, the following cell lines are generated through Cas9 knock-in at the Rosa26 locus in PAM or WSL cells (Sanchez et al. 2017).

Cell line 1: pU6 and p7SK each drive 5 guides against ASFV
Cell line 2: EF1a drives 10 guides against ASFV
Cell line 3: pU6 and p7SK each drive 5 guides against SuHV1
Cell line 4: EF1a drives 10 guides against SuHV1

Viral Challenge Experiments

The cell line is challenged with the relevant virus and the effect of the engineered defense system is evaluated through plaque assays and/or challenging the cell lines with a recombinant (fluorescent protein tagged) version of the virus. For ASFV, the cell lines are evaluated by blinded testing at a BL4 facility.

Results and Discussion

Functional Cas12a gRNA scaffolds with limited homology enable synthesis of large guide arrays for expanded multiplexed targeting. Limiting internal homology also enhances the stability of large arrays in vivo, due to reduced risk of homologous recombination both within and between guide arrays. The generational stability of large arrays is a particular concern in gene drive contexts, where maintaining the fidelity of CRISPR components encoded at multiple sites in the genome is critical for propagation of the drive.

Example 4

Validating Viral Spacer Targeting Efficiency with Diverse Cas12a Repeats in Mammalian Cells.

Figure 9A:
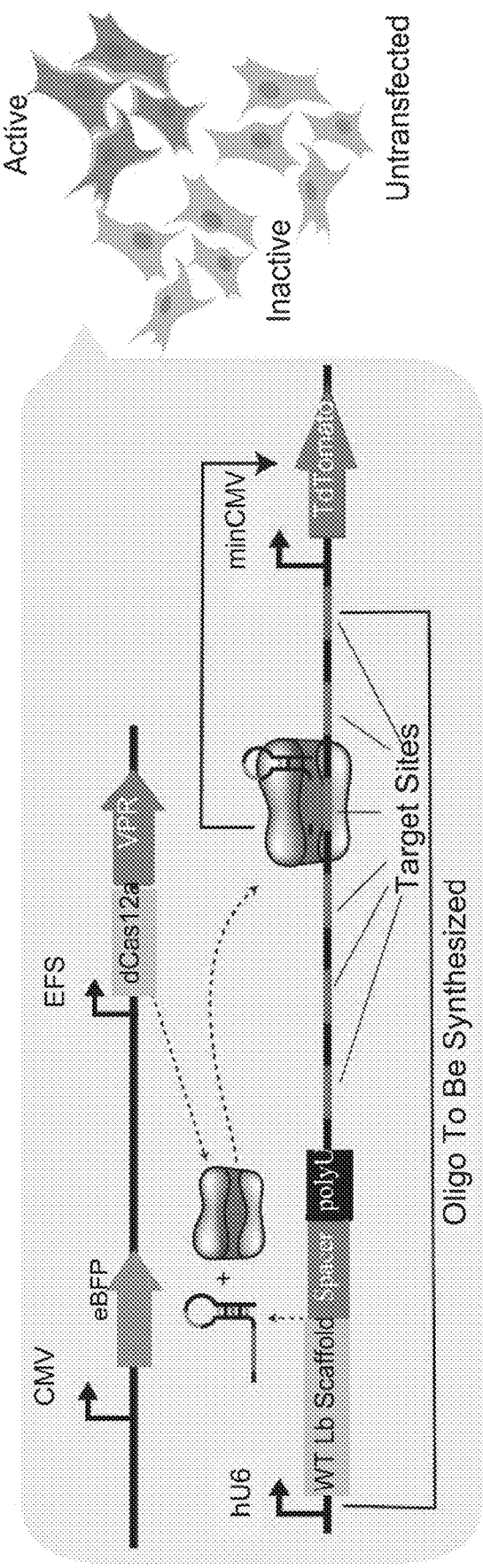
FIG. 9A-B presents a schematic diagram and photomicrographs from a mammalian assay to validate viral spacer targeting efficiency with diverse Cas12a repeats.

To test functionality in mammalian cells with different spacers in order to quantify the impact of secondary structure on DNA targeting efficiency, a transcriptional activation assay was designed based on dCas12a-VPR to test top scaffold variants paired with diverse spacers in 293T cells (FIG. 9A). The goal was to improve the combined VPR reporter construct by examining several variables: the optimal number of binding sites, spacing between binding sites, and the distance between binding sites and the reporter gene.

This assay is important because although many CRISPR knockout screens exist for the human genome and that of other model species, there is no known assay that will enable high-throughput testing of viral CRISPR targeting sequences through an activation screen. This feature is crucial for viruses that are difficult or dangerous to work with, because it permits obtaining an optimal targeting sequence for a virus prior to viral infection screens.

A VPR reporter with 7 TetO targeting sites upstream of the TdTomato gene was used as a positive control. The positive control VPR reporter was co-transfected with a plasmid containing a wild-type scaffold and the TetO spacer driven by a U6 guide. A randomly generated "scaffold" followed by the TetO spacer was used as a negative control.

Optimal binding site number was tested using 1, 2, or 3 binding sites. Spacing between binding sites was tested by placing the binding sites either 0 bp apart or 30 bp apart. Distance between binding sites and the reporter gene was tested by placing the minCMV promoter either 100 or 200 bp upstream of the TdTomato cassette. It was observed that increasing the number of binding sites boosted expression of TdTomato, and that binding sites needed to be spaced apart for optimal signal, possibly due to steric hindrance when multiple Cas12a-VPR constructs bound adjacent targeting sites.

Figure 9B:
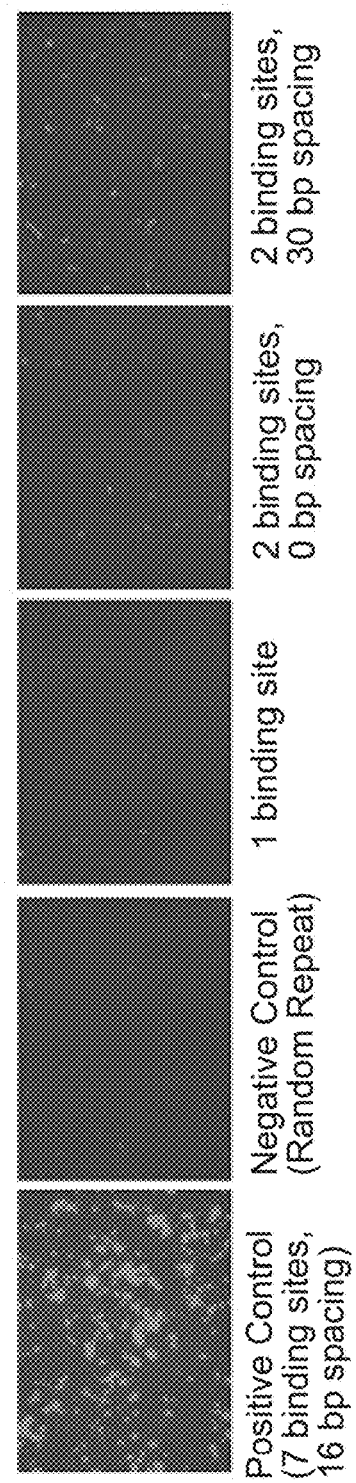

A final plasmid for screening target/crRNA scaffold variant pairs was then designed with six binding sites separated by 16 bp of random sequence, which is the maximum number of sites that fit into a 300 bp oligo (FIG. 9B). This assay also allows testing the efficiency of binding to viral target sequences without the need for viral infection in cell culture conditions. By transfecting a library of possible viral spacer sequences, the best targets for engineering a virus-resistant mammalian cell line can be identified.

Example 5

Figure 10:
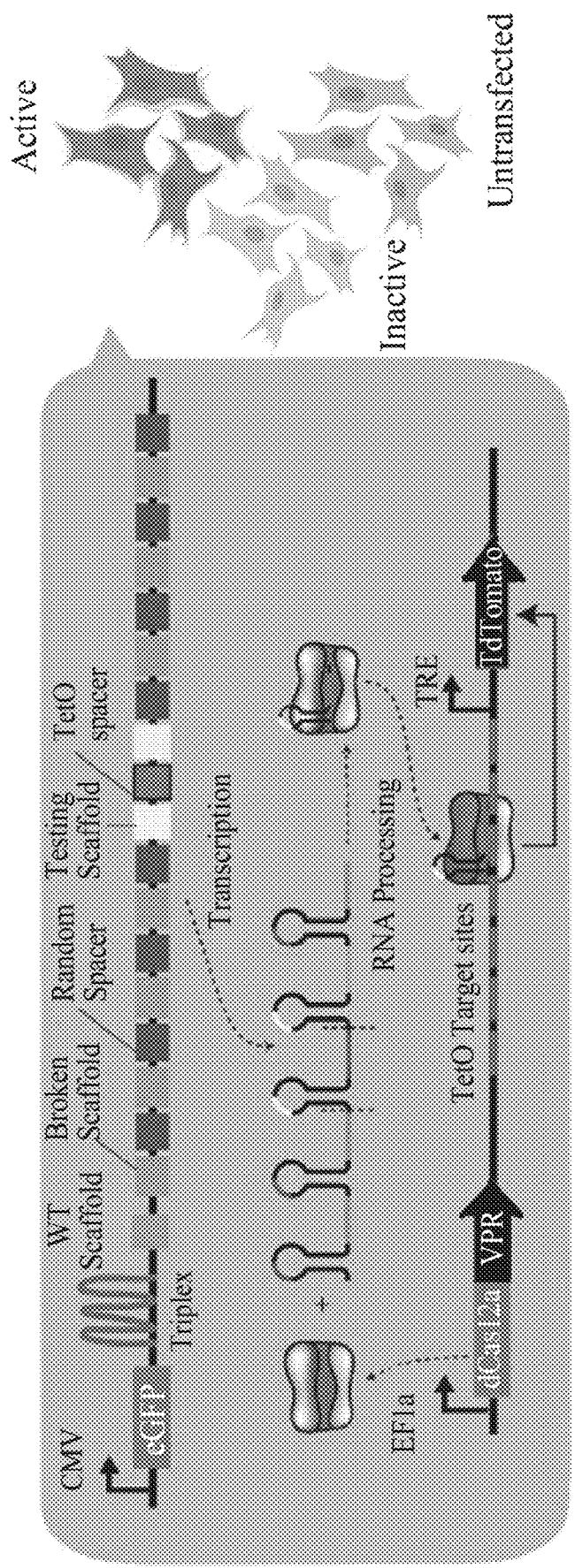
FIG. 10 presents a schematic diagram of a mammalian "broken array" circuit design. The "broken array" circuit assay was designed to validate dual DNA binding and RNA processing.

Mammalian "Broken Array" to Validate Dual DNA Binding and RNA Processing.
Mammalian "Broken" Array Circuit Design To verify that the top variant crRNA scaffolds function within arrays by being processed into individual guides, a "broken array" assay was designed (FIG. 10, FIG. 11A) in which a ten-member array made of non-processing variants that still bind DNA (as determined by the in vitro processing assay and DNA binding and RNA processing screens in Examples 1-2) and random spacer sequences were cloned into the 3' UTR of the EGFP gene expressed from the strong CMV promoter. To confirm array expression and functionality, a triplex sequence allowing continued translation of EGFP after Cas12a processing was included upstream of the scaffold array. Golden Gate sites in the middle of the array allow a crRNA scaffold variant to be cloned into the array to either side of a TetO spacer that directs dCas12a-VPR to activate a TdTomato reporter. Non-processing scaffolds will be trapped and fail to activate TdTomato; scaffolds that cannot mediate DNA-binding will also yield no signal. Processing at both copies of the crRNA scaffold being tested will excise the functional TetO-targeting crRNA unit in between. If the test scaffold can also mediate DNA-binding, it will yield TdTomato fluorescence.

Figure 11A:
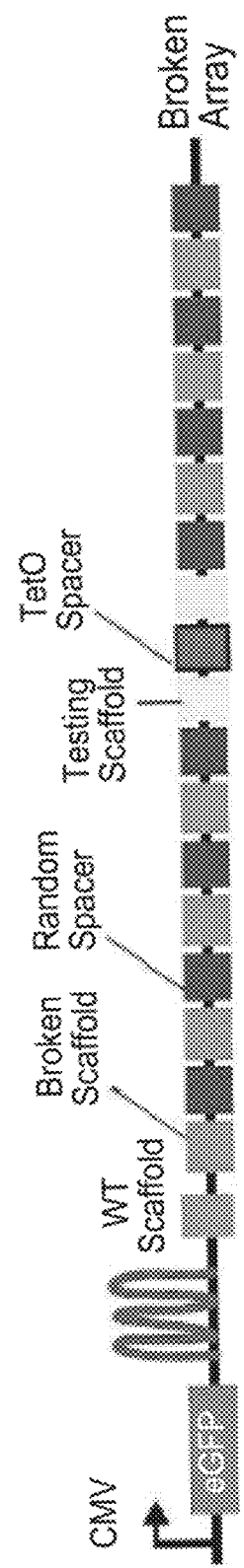
FIG. 11A-C presents a schematic, graph and photomicrographs from a "broken" array circuit assay.
Figure 11B:
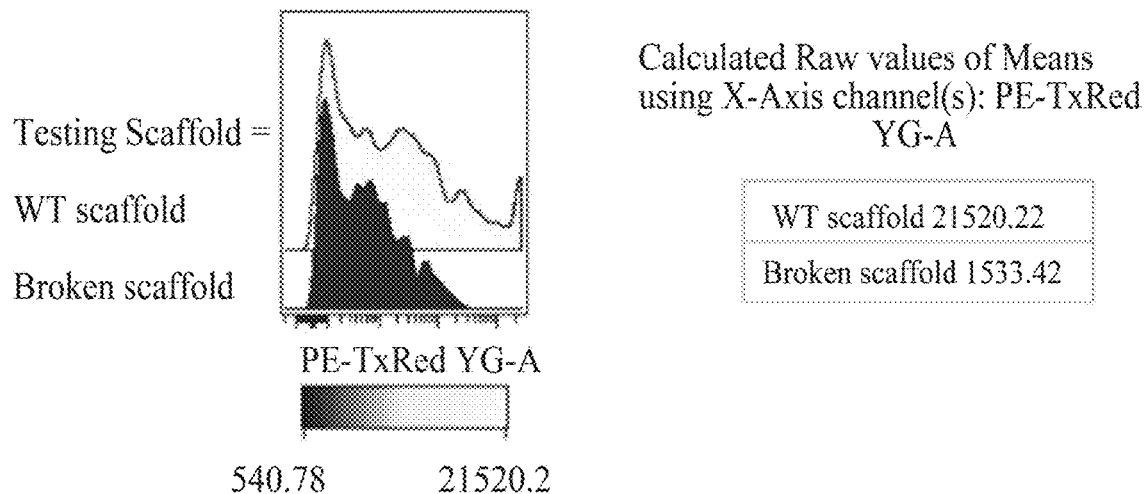
Figure 11C:
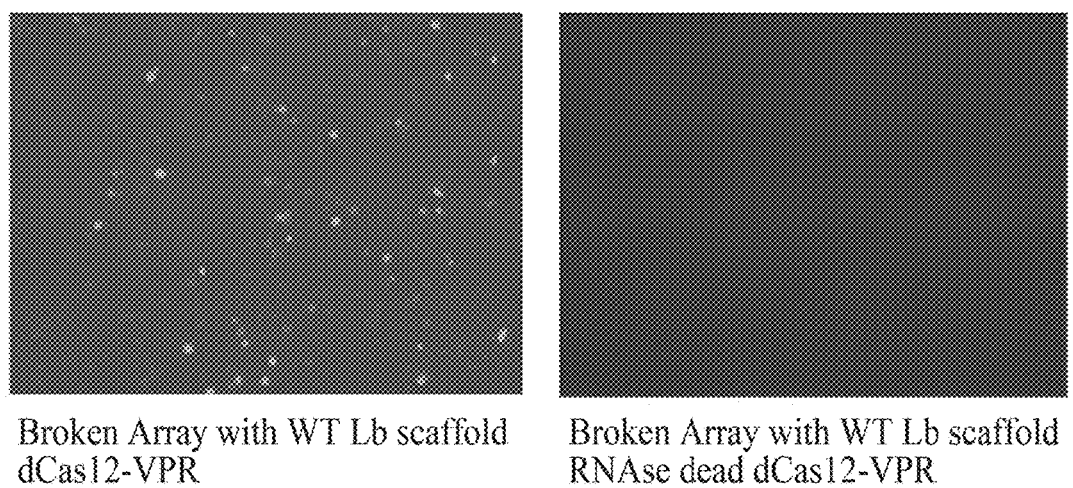

This assay, which requires both DNA-binding and processing in mammalian cells, is used to validate the top mutant scaffolds enriched in both the bacterial DNA binding and RNA processing screens. A pool of top scaffold sequences (approximately 200) have been pulled from the bacterial DNA binding and RNA processing library screens to test in the broken array assay. Results of the "broken" assay will confirm the results of the prior bacterial library screens in a mammalian context. FIG. 11A-C provides overview of Broken array assay. FIG. 11A shows the "Broken" array circuit design; FIG. 11B shows results of fluorescent cytometry analysis of broken array containing either a wild-type scaffold flanking the TetO spacer or a broken (non-RNA-processing) scaffold variant; and FIG. 11C shows fluorescent microscopy images of HEK293T cells co-transfected with a TetO VPR Reporter construct, a broken array construct containing the wild-type scaffold flanking the TetO spacer, and either a RNase-active or RNase-inactive dLbCas12a-VPR.

This assay is used to assess the top scaffolds, which are cloned into the plasmid and transfected into HEK293T cells in 96-well plate format prior to evaluation by flow cytometry. The wild-type scaffold serves as a positive control; a random scaffold and a random spacer serve as negative controls. It is identified that all transfected cells express GFP, but TdTomato expression is only detected in those with variants that can both be processed and direct DNA binding.
Results A 10-member array was built of crRNA scaffolds that can mediate DNA binding but not RNA processing with a TdTomato activating spacer in the center. This array failed to activate transcription of the TdTomato reporter upon co-transfection with dLbCas12a-VPR into HEK293 cells (FIG. 11A). In contrast, a construct expressing the wild-type crRNA scaffold flanking the activating spacer exhibited fluorescence activation, as seen by flow cytometry analysis (FIG. 11B). This result is consistent with the hypothesis that positioning an otherwise active crRNA that cannot be processed in the context of a similarly non-processing array greatly impairs activity, presumably due to secondary structure or interference by competing Cas12a-crRNA units in the same transcript.

Placing the non-processing but DNA-binding scaffold on its own downstream of a U6 promoter led to transcriptional activation of TdTomato, demonstrating that the broken array assay yields positive results only for scaffolds that combine RNA-processing and DNA-binding activity. To confirm these results, the assay was repeated with the wild-type scaffold and an RNase-dead version of dCas12a-VPR (FIG. 11B), which failed to process and therefore activate transcription (FIG. 11C). These results validate the ability of the broken array assay to identify crRNA scaffolds capable of mediating both RNA-processing and DNA-binding in mammalian cells.

CERTAIN REFERENCES

Chen Shi-Jin, Fan Jing, Jiang Qin-Yang, Lan Gan-Qiu, Guo Xiao-Ping, and Guo Ya-Fen. 2012. "[Cloning and functional verification of U6 and 7SK promoter of small RNA from Bama mini-pig in Guangxi]." *Yi chuan=Hereditas/Zhongguo yi chuan xue hui bian ji* 34 (4): 445-53.

Freitas, Ferdinando B., Goncalo Frouco, Carlos Martins, and Fernando Ferreira. 2018. "African Swine Fever Virus Encodes for an E2-Ubiquitin Conjugating Enzyme That Is Mono- and Di-Ubiquitinated and Required for Viral Replication Cycle." *Scientific Reports* 8 (1): 3471.

Freitas, Ferdinando B., Goncalo Frouco, Carlos Martins, Alexandre Leitão, and Fernando Ferreira. 2016. "In Vitro Inhibition of African Swine Fever Virus-Topoisomerase II Disrupts Viral Replication." *Antiviral Research* 134 (October): 34-41.

Gao, Linyi, et al. "Engineered Cpf1 variants with altered PAM specificities." *Nature Biotechnology* 35.8 (2017): 789.

Katoh, Kazutaka, and Daron M. Standley. 2013. "MAFFT Multiple Sequence Alignment Software Version 7: Improvements in Performance and Usability." *Molecular Biology and Evolution* 30(4): 772-80.

Keita, Djénéba, Livio Heath, and Emmanuel Albina. 2010. "Control of African Swine Fever Virus Replication by Small Interfering RNA Targeting the A151R and VP72 Genes." *Antiviral Therapy* 15 (5): 727-36.

Kong, Qingran, Tang Hai, Jing Ma, Tianqing Huang, Dandan Jiang, Bingteng Xie, Meiling Wu, et al. 2014. "Rosa26 Locus Supports Tissue-Specific Promoter Driving Transgene Expression Specifically in Pig." *PloS One* 9 (9): e107945.

Li, Ping, Christopher Burlak, Jose Estrada, Peter J. Cowan, and A. Joseph Tector. 2014. "Identification and Cloning of the Porcine ROSA26 Promoter and Its Role in Transgenesis." *Transplantation Technology* 2 (1): 1.

Petkov, Stoyan, Poul Hyttel, and Heiner Niemann. 2013. "The Choice of Expression Vector Promoter Is an Important Factor in the Reprogramming of Porcine Fibroblasts into Induced Pluripotent Cells." *Cellular Reprogramming* 15 (1): 1-8.

Sánchez, Elena G., Elena Riera, Marisa Nogal, Carmina Gallardo, Paloma Fernández, Raquel Bello-Morales, José Antonio López-Guerrero, Carol G. Chitko-McKown, Jürgen A. Richt, and Yolanda Revilla. 2017. "Phenotyping and Susceptibility of Established Porcine Cells Lines to African Swine Fever Virus Infection and Viral Production." *Scientific Reports* 7 (1): 10369.

Statement for all Examples

Means for designing constructing, integrating, and implementing such systems of the invention as well as preparing organism strains and releasing organisms of such strains, etc. that include such systems of the invention is carried out using the teaching presented herein, and in certain instances in conjunction with methods, components, and/or elements known in the art.

EQUIVALENTS

Although several embodiments of the present invention have been described and illustrated herein, those of ordinary skill in the art will readily envision a variety of other means and/or structures for performing the functions and/or obtaining the results and/or one or more of the advantages described herein, and each of such variations and/or modifications is deemed to be within the scope of the present invention. More generally, those skilled in the art will readily appreciate that all parameters, dimensions, materials, and configurations described herein are meant to be exemplary and that the actual parameters, dimensions, materials, and/or configurations will depend upon the specific application or applications for which the teachings of the present invention is/are used. Those skilled in the art will recognize, or be able to ascertain using no more than routine experimentation, many equivalents to the specific embodiments of the invention described herein. It is, therefore, to be understood that the foregoing embodiments are presented by way of example only and that, within the scope of the appended claims and equivalents thereto; the invention may be practiced otherwise than as specifically described and claimed. The present invention is directed to each individual feature, system, article, material, and/or method described herein. In addition, any combination of two or more such features, systems, articles, materials, and/or methods, if such features, systems, articles, materials, and/or methods are not mutually inconsistent, is included within the scope of the present invention.

All definitions, as defined and used herein, should be understood to control over dictionary definitions, definitions in documents incorporated by reference, and/or ordinary meanings of the defined terms.

The indefinite articles "a" and "an," as used herein in the specification and in the claims, unless clearly indicated to the contrary, should be understood to mean "at least one."

The phrase "and/or," as used herein in the specification and in the claims should be understood to mean "either or both" of the elements so conjoined, i.e., elements that are conjunctively present in some cases and disjunctively present in other cases. Other elements may optionally be present other than the elements specifically identified by the "and/or" clause, whether related or unrelated to those elements specifically identified, unless clearly indicated to the contrary.

All references, patents and patent applications and publications cited or referred to in this application are incorporated herein in their entirety herein by reference.

SEQUENCE LISTING (3280 sequences)

SEQ ID NO: 1 - RNA, 21 nt, Artificial sequence
  Synthetic Oligonucleotide
uaauuucuacuaaguguagau

SEQ ID NO: 2 - DNA, 21 bp, Artificial Sequence
  Synthetic Oligonucleotide
  misc_feature (1)..(1): N is A, T, G, or C
naatttctactaagtgtagat

SEQ ID NO: 3 - DNA, 21 bp, Artificial Sequence
  Synthetic Oligonucleotide
  misc_feature (2)..(2): N is A, T, G, or C
tnatttctactaagtgtagat

SEQ ID NO: 4 - DNA, 21 bp, Artificial Sequence
  Synthetic Oligonucleotide
  misc_feature: N is A, T, G, or C
  misc_feature (3)..(3): N is A, T, G, or C
tantttctactaagtgtagat

SEQ ID NO: 5 - DNA, 21 bp, Artificial Sequence
  Synthetic Oligonucleotide
  misc_feature (4)..(4): N is A, T, G, or C
taanttctactaagtgtagat

SEQ ID NO: 6 - DNA, 21 bp, Artificial Sequence
  Synthetic Oligonucleotide
  misc_feature (5)..(5): N is A, T, G, or C
taatntctactaagtgtagat

SEQ ID NO: 7 - DNA, 21 bp, Artificial Sequence
  Synthetic Oligonucleotide
  misc_feature (6)..(6): N is A, T, G, or C
taattnctactaagtgtagat

SEQ ID NO: 8 - DNA, 21 bp, Artificial Sequence
  Synthetic Oligonucleotide
  misc_feature (7)..(7): N is A, T, G, or C
taatttntactaagtgtagat

SEQ ID NO: 9 - DNA, 21 bp, Artificial Sequence
  Synthetic Oligonucleotide
  misc_feature (8)..(8): N is A, T, G, or C
taatttcnactaagtgtagat

SEQ ID NO: 10 - DNA, 21 bp, Artificial Sequence
  Synthetic Oligonucleotide
  misc_feature (9)..(9): N is A, T, G, or C
taatttctnctaagtgtagat

SEQ ID NO: 11 - DNA, 21 bp, Artificial Sequence
  Synthetic Oligonucleotide
  misc_feature (10)..(10): N is A, T, G, or C
taatttctantaagtgtagat

SEQ ID NO: 12 - DNA, 21 bp, Artificial Sequence
  Synthetic Oligonucleotide
  misc_feature (11)..(11): N is A, T, G, or C
taatttctacnaagtgtagat

SEQ ID NO: 13 - DNA, 21 bp, Artificial Sequence
  Synthetic Oligonucleotide
  misc_feature (12)..(12): N is A, T, G, or C
taatttctactnagtgtagat

SEQ ID NO: 14 - DNA, 21 bp, Artificial Sequence
  Synthetic Oligonucleotide
  misc_feature (13)..(13): N is A, T, G, or C
taatttctactangtgtagat

SEQ ID NO: 15 - DNA, 21 bp, Artificial Sequence
  Synthetic Oligonucleotide
  misc_feature (14)..(14): N is A, T, G, or C
taatttctactaantgtagat

SEQ ID NO: 16 - DNA, 21 bp, Artificial Sequence
  Synthetic Oligonucleotide
  misc_feature (15)..(15): N is A, T, G, or C
taatttctactaagngtagat

SEQ ID NO: 17 - DNA, 21 bp, Artificial Sequence
  Synthetic Oligonucleotide
  misc_feature (16)..(16): N is A, T, G, or C
taatttctactaagtntagat

SEQ ID NO: 18 - DNA, 21 bp, Artificial Sequence
  Synthetic Oligonucleotide
  misc_feature (17)..(17): N is A, T, G, or C
taatttctactaagtgnagat

SEQ ID NO: 19 - DNA, 21 bp, Artificial Sequence
  Synthetic Oligonucleotide
  misc_feature (18)..(18): N is A, T, G, or C
taatttctactaagtgtngat

SEQ ID NO: 20 - DNA, 21 bp, Artificial Sequence
  Synthetic Oligonucleotide
  misc_feature (19)..(19): N is A, T, G, or C
taatttctactaagtgtanat

SEQ ID NO: 21 - DNA, 21 bp, Artificial Sequence
  Synthetic Oligonucleotide
  misc_feature (20)..(20): N is A, T, G, or C
taatttctactaagtgtagnt

SEQ ID NO: 22 - DNA, 21 bp, Artificial Sequence
  Synthetic Oligonucleotide
  misc_feature (21)..(21): N is A, T, G, or C
taatttctactaagtgtagan

SEQ ID NO: 23 - DNA, 21 bp, Artificial Sequence
  Synthetic Oligonucleotide
  misc_feature (6)..(6): N is A, T, G, or C
  misc_feature (20)..(20): N is A, T, G, or C
taattnctactaagtgtagnt

SEQ ID NO: 24 - DNA, 21 bp, Artificial Sequence
  Synthetic Oligonucleotide
  misc_feature (7)..(19): N is A, T, G, or C
taatttntactaagtgtanat

SEQ ID NO: 25 - DNA, 21 bp, Artificial Sequence
  Synthetic Oligonucleotide
  misc_feature (8)..(18): N is A, T, G, or C
taatttcnactaagtgtngat

SEQ ID NO: 26 - DNA, 21 bp, Artificial Sequence
  Synthetic Oligonucleotide
  misc_feature (9)..(17): N is A, T, G, or C
taatttctnctaagtgnagat

SEQ ID NO: 27 - DNA, 21 bp, Artificial Sequence
  Synthetic Oligonucleotide
  misc_feature (10)..(16): N is A, T, G, or C
taatttctantaagtntagat

SEQ ID NO: 28 - DNA, 20 bp, Artificial Sequence
  Synthetic Oligonucleotide
  misc_feature (1)..(14): N is A, T, G, or C
naatttatactnnngtatat

SEQ ID NO: 29 - DNA, 20 bp, Artificial Sequence
  Synthetic Oligonucleotide
  misc_feature (1)..(14): N is A, T, G, or C
naatttctgctnnngcagat

SEQ ID NO: 30 - DNA, 20 bp, Artificial Sequence
  Synthetic Oligonucleotide
  misc_feature (1)..(14): N is A, T, G, or C
naatttctcctnnnggagat

SEQ ID NO: 31 - DNA, 20 bp, Artificial Sequence
  Synthetic Oligonucleotide
  misc_feature (1)..(14): N is A, T, G, or C
naatttctactnnngtagat

SEQ ID NO: 32 - DNA, 21 bp, Artificial Sequence
  Synthetic Oligonucleotide
  misc_feature (1)..(1): N is A, T, G, or C
naatttctactaagtgtagat

SEQ ID NO: 33 - DNA, 21 bp, Artificial Sequence
  Synthetic Oligonucleotide
  misc_feature (1)..(1): N is A, T, G, or C
ncatttctactaagtgtagat

SEQ ID NO: 34 - DNA, 21 bp, Artificial Sequence
  Synthetic Oligonucleotide
  misc_feature (1)..(1): N is A, T, G, or C
nactttctactaagtgtagat

SEQ ID NO: 35 - DNA, 21 bp, Artificial Sequence
  Synthetic Oligonucleotide
  misc_feature (1)..(1): N is A, T, G, or C
ncctttctactaagtgtagat

SEQ ID NO: 36 - DNA, 21 bp, Artificial Sequence
  Synthetic Oligonucleotide
  misc_feature (1)..(1): N is A, T, G, or C
naatttctaccaagtgtagat

SEQ ID NO: 37 - DNA, 21 bp, Artificial Sequence
  Synthetic Oligonucleotide
  misc_feature (1)..(12): N is A, T, G, or C
naatttctactnagtgtagat

SEQ ID NO: 38 - DNA, 21 bp, Artificial Sequence
  Synthetic Oligonucleotide
  misc_feature (1)..(13): N is A, T, G, or C
naatttctactangtgtagat

SEQ ID NO: 39 - DNA, 21 bp, Artificial Sequence
  Synthetic Oligonucleotide
  misc_feature (1)..(14): N is A, T, G, or C
naatttctactaantgtagat

SEQ ID NO: 40 - DNA, 21 bp, Artificial Sequence
  Synthetic Oligonucleotide
  misc_feature (1)..(14): N is A, T, G, or C
naatttctactaanggtagat

SEQ ID NO: 41 - DNA, 21 bp, Artificial Sequence
  Synthetic Oligonucleotide
  misc_feature (1)..(1): N is A, T, G, or C
naatttctactaagtgtaggt

SEQ ID NO: 42 - DNA, 21 bp, Artificial Sequence
  Synthetic Oligonucleotide
  misc_feature (1)..(1): N is A, T, G, or C
naatttctactaagtgtggat

SEQ ID NO: 43 - DNA, 21 bp, Artificial Sequence
  Synthetic Oligonucleotide
  misc_feature (1)..(1): N is A, T, G, or C
naatttatactaagtgtatat

SEQ ID NO: 44 - DNA, 21 bp, Artificial Sequence
  Synthetic Oligonucleotide
  misc_feature (1)..(1): N is A, T, G, or C
naatttctcctaagtgtaggt

SEQ ID NO: 45 - DNA, 21 bp, Artificial Sequence
  Synthetic Oligonucleotide
  misc_feature (1)..(1): N is A, T, G, or C
naatttctgctaagtgtaggt

SEQ ID NO: 46 - DNA, 21 bp, Artificial Sequence
  Synthetic Oligonucleotide
  misc_feature (1)..(1): N is A, T, G, or C
naatttcgactaagtgtcgat

SEQ ID NO: 47 - DNA, 21 bp, Artificial Sequence
  Synthetic Oligonucleotide
  misc_feature (1)..(1): N is A, T, G, or C
naatttctactaagtgcagat

SEQ ID NO: 48 - DNA, 21 bp, Artificial Sequence
  Synthetic Oligonucleotide
  misc_feature (1)..(1): N is A, T, G, or C
naatttctattaagtgtagat

SEQ ID NO: 49 - DNA, 20 bp, Artificial Sequence
  Synthetic Oligonucleotide
  misc_feature (1)..(1): N is A, T, G, or C
naatttatactacggtatat

SEQ ID NO: 50 - DNA, 20 bp, Artificial Sequence
  Synthetic Oligonucleotide
  misc_feature (1)..(1): N is A, T, G, or C
naatttatactatcgtatat

SEQ ID NO: 51 - DNA, 20 bp, Artificial Sequence
  Synthetic Oligonucleotide
  misc_feature (1)..(1): N is A, T, G, or C
naatttatactttgtgatat

SEQ ID NO: 52 - DNA, 20 bp, Artificial Sequence
  Synthetic Oligonucleotide
  misc_feature (1)..(1): N is A, T, G, or C
naatttctgctacagcagat

SEQ ID NO: 53 - DNA, 20 bp, Artificial Sequence
  Synthetic Oligonucleotide
  misc_feature (1)..(1): N is A, T, G, or C
naatttctgctaccgcagat

SEQ ID NO: 54 - DNA, 20 bp, Artificial Sequence
  Synthetic Oligonucleotide
  misc_feature (1)..(1): N is A, T, G, or C
naatttctgctacggcagat

SEQ ID NO: 55 - DNA, 20 bp, Artificial Sequence
  Synthetic Oligonucleotide
  misc_feature (1)..(1): N is A, T, G, or C
naatttctgctactgcagat

SEQ ID NO: 56 - DNA, 20 bp, Artificial Sequence
  Synthetic Oligonucleotide
  misc_feature (1)..(1): N is A, T, G, or C
naatttctgctagcgcagat

SEQ ID NO: 57 - DNA, 20 bp, Artificial Sequence
  Synthetic Oligonucleotide
  misc_feature (1)..(14): N is A, T, G, or C
naatttctgctatngcagat

SEQ ID NO: 58 - DNA, 20 bp, Artificial Sequence
  Synthetic Oligonucleotide
  misc_feature (1)..(1): N is A, T, G, or C
naatttctgctctagcagat

SEQ ID NO: 59 - DNA, 20 bp, Artificial Sequence
  Synthetic Oligonucleotide
  misc_feature (1)..(1): N is A, T, G, or C
naatttctcctaaaggagat

SEQ ID NO: 60 - DNA, 20 bp, Artificial Sequence
  Synthetic Oligonucleotide
  misc_feature (1)..(1): N is A, T, G, or C
naatttctcctaatggagat

SEQ ID NO: 61 - DNA, 20 bp, Artificial Sequence
  Synthetic Oligonucleotide
  misc_feature (1)..(14): N is A, T, G, or C
naatttctcctacnggagat

SEQ ID NO: 62 - DNA, 20 bp, Artificial Sequence
  Synthetic Oligonucleotide
  misc_feature (1)..(1): N is A, T, G, or C
naatttctcctagaggagat

SEQ ID NO: 63 - DNA, 20 bp, Artificial Sequence
  Synthetic Oligonucleotide
  misc_feature (1)..(1): N is A, T, G, or C
naatttctcctagtggagat

SEQ ID NO: 64 - DNA, 20 bp, Artificial Sequence
  Synthetic Oligonucleotide
  misc_feature (1)..(14): N is A, T, G, or C
naatttctcctatnggagat

SEQ ID NO: 65 - DNA, 20 bp, Artificial Sequence
  Synthetic Oligonucleotide
  misc_feature (1)..(1): N is A, T, G, or C
naatttctcctcatggagat

SEQ ID NO: 66 - DNA, 20 bp, Artificial Sequence
  Synthetic Oligonucleotide
  misc_feature (1)..(1): N is A, T, G, or C
naatttctcctccaggagat

SEQ ID NO: 67 - DNA, 20 bp, Artificial Sequence
  Synthetic Oligonucleotide
  misc_feature (1)..(1): N is A, T, G, or C
naatttctcctcctggagat

SEQ ID NO: 68 - DNA, 20 bp, Artificial Sequence
  Synthetic Oligonucleotide
  misc_feature (1)..(14): N is A, T, G, or C
naatttctcctctnggagat

SEQ ID NO: 69 - DNA, 20 bp, Artificial Sequence
  Synthetic Oligonucleotide
  misc_feature (1)..(1): N is A, T, G, or C
naatttctcctgttggagat

SEQ ID NO: 70 - DNA, 20 bp, Artificial Sequence
  Synthetic Oligonucleotide
  misc_feature (1)..(1): N is A, T, G, or C
naatttctccttcaggagat

SEQ ID NO: 71 - DNA, 20 bp, Artificial Sequence
  Synthetic Oligonucleotide
  misc_feature (1)..(1): N is A, T, G, or C
naatttctccttctggagat

SEQ ID NO: 72 - DNA, 20 bp, Artificial Sequence
  Synthetic Oligonucleotide
  misc_feature (1)..(1): N is A, T, G, or C
naatttctccttgtggagat

SEQ ID NO: 73 - DNA, 20 bp, Artificial Sequence
  Synthetic Oligonucleotide
  misc_feature (1)..(1): N is A, T, G, or C
naatttctccttttggagat

SEQ ID NO: 74 - DNA, 20 bp, Artificial Sequence
  Synthetic Oligonucleotide
  misc_feature (1)..(14): N is A, T, G, or C
naatttctaccnnngtagat

SEQ ID NO: 75 - DNA, 21 bp, Artificial Sequence
  Synthetic Oligonucleotide
taatttctactaagtgtagat

SEQ ID NO: 76 - DNA, 23 bp, Artificial Sequence
  Synthetic Oligonucleotide
tatcagtgatagagaacgtatgt

SEQ ID NO: 77 - DNA, 20 bp, Artificial Sequence
  Synthetic Oligonucleotide
caatttctactcttgtagat

SEQ ID NO: 78 - DNA, 20 bp, Artificial Sequence
  Synthetic Oligonucleotide
aaattgttgttcttacagct

SEQ ID NO: 79 - DNA, 21 bp, Artificial Sequence
  Synthetic Oligonucleotide
caattatttgtaagttgaatt

SEQ ID NO: 80 - DNA, 20 bp, Artificial Sequence
  Synthetic Oligonucleotide
caatttctcctcttggagat

SEQ ID NO: 81 - DNA, 21 bp, Artificial Sequence
  Synthetic Oligonucleotide
caattgtgtttaagtagtatt

SEQ ID NO: 82 - DNA, 20 bp, Artificial Sequence
  Synthetic Oligonucleotide
aaattatgcctcttggtatt

SEQ ID NO: 83 - DNA, 20 bp, Artificial Sequence
  Synthetic Oligonucleotide
aaattagcattcttgtgctt

SEQ ID NO: 84 - DNA, 21 bp, Artificial Sequence
  Synthetic Oligonucleotide
gaattaccgttaagtatggtt

SEQ ID NO: 85 - DNA, 20 bp, Artificial Sequence
  Synthetic Oligonucleotide
caattcctactcttgtaggt

SEQ ID NO: 86 - DNA, 20 bp, Artificial Sequence
  Synthetic Oligonucleotide
aaattcctactcttgtaggt

SEQ ID NO: 87 - DNA, 20 bp, Artificial Sequence
  Synthetic Oligonucleotide
caattggtgctcttgtgctt

SEQ ID NO: 88 - DNA, 20 bp, Artificial Sequence
  Synthetic Oligonucleotide
aaattatcgctcttgtggtt

SEQ ID NO: 89 - DNA, 21 bp, Artificial Sequence
  Synthetic Oligonucleotide
aaattgatgctaagtgtgtct

SEQ ID NO: 90 - DNA, 21 bp, Artificial Sequence
  Synthetic Oligonucleotide
gaattaagtgtaagttgtttt

SEQ ID NO: 91 - DNA, 20 bp, Artificial Sequence
  Synthetic Oligonucleotide
caattggggttcttgccctt

SEQ ID NO: 92 - DNA, 21 bp, Artificial Sequence
  Synthetic Oligonucleotide
gaatttcggttaagtgtcggt

SEQ ID NO: 93 - DNA, 21 bp, Artificial Sequence
  Synthetic Oligonucleotide
aaattcgatctaagtgatcgt

SEQ ID NO: 94 - DNA, 21 bp, Artificial Sequence
  Synthetic Oligonucleotide
caattatgtgtaagttgtatt

SEQ ID NO: 95 - DNA, 20 bp, Artificial Sequence
  Synthetic Oligonucleotide
gaattatccgtcttcgggtt

SEQ ID NO: 96 - DNA, 21 bp, Artificial Sequence
  Synthetic Oligonucleotide
gaattgctgttaagtacagct

SEQ ID NO: 97 - DNA, 21 bp, Artificial Sequence
  Synthetic Oligonucleotide
gaattcggcttaagtagctgt

SEQ ID NO: 98 - DNA, 20 bp, Artificial Sequence
  Synthetic Oligonucleotide
gaattcttcctcttggaagt

SEQ ID NO: 99 - DNA, 21 bp, Artificial Sequence
  Synthetic Oligonucleotide
caattagacgtaagtcgtctt

SEQ ID NO: 100 - DNA, 20 bp, Artificial Sequence
  Synthetic Oligonucleotide
aaattggcgctcttgtgtct

SEQ ID NO: 101 - DNA, 21 bp, Artificial Sequence
  Synthetic Oligonucleotide
aaatttgtcataagttggcgt

SEQ ID NO: 102 - DNA, 21 bp, Artificial Sequence
  Synthetic Oligonucleotide
caattcaatctaagtggttgt

SEQ ID NO: 103 - DNA, 20 bp, Artificial Sequence
  Synthetic Oligonucleotide
aaattcggtgtcttcgtcgt

SEQ ID NO: 104 - DNA, 20 bp, Artificial Sequence
  Synthetic Oligonucleotide
aaattggacgtcttcgttct

SEQ ID NO: 105 - DNA, 20 bp, Artificial Sequence
  Synthetic Oligonucleotide
gaattggatgtctttgtctt

SEQ ID NO: 106 - DNA, 20 bp, Artificial Sequence
  Synthetic Oligonucleotide
caattgttggtcttctagtt

SEQ ID NO: 107 - DNA, 20 bp, Artificial Sequence
  Synthetic Oligonucleotide
gaattcggcatctttgctgt

SEQ ID NO: 108 - DNA, 21 bp, Artificial Sequence
  Synthetic Oligonucleotide
gaatttgttgtaagttaacat

SEQ ID NO: 109 - DNA, 21 bp, Artificial Sequence
  Synthetic Oligonucleotide
caattggtggtaagtccgcct

SEQ ID NO: 110 - DNA, 20 bp, Artificial Sequence
  Synthetic Oligonucleotide
gaattgtatgtcttcatgct

SEQ ID NO: 111 - DNA, 21 bp, Artificial Sequence
  Synthetic Oligonucleotide
caattgagtgtaagttatttt

SEQ ID NO: 112 - DNA, 20 bp, Artificial Sequence
  Synthetic Oligonucleotide
caattggggctcttgctctt

SEQ ID NO: 113 - DNA, 21 bp, Artificial Sequence
  Synthetic Oligonucleotide
caattcgtcttaagtagacgt

SEQ ID NO: 114 - DNA, 20 bp, Artificial Sequence
  Synthetic Oligonucleotide
aaatttgcgttcttgcgtat

SEQ ID NO: 115 - DNA, 21 bp, Artificial Sequence
  Synthetic Oligonucleotide
aaattggtagtaagtctattt

SEQ ID NO: 116 - DNA, 21 bp, Artificial Sequence
  Synthetic Oligonucleotide
caattgacgataagttcgttt

SEQ ID NO: 117 - DNA, 21 bp, Artificial Sequence
  Synthetic Oligonucleotide
gaattcgtcttaagtaggcgt

SEQ ID NO: 118 - DNA, 20 bp, Artificial Sequence
  Synthetic Oligonucleotide
aaattgctgctcttgtggct

SEQ ID NO: 119 - DNA, 20 bp, Artificial Sequence
  Synthetic Oligonucleotide
gaattcatggtcttttgtgt

SEQ ID NO: 120 - DNA, 20 bp, Artificial Sequence
  Synthetic Oligonucleotide
caattggtggtcttttgcct

SEQ ID NO: 121 - DNA, 21 bp, Artificial Sequence
  Synthetic Oligonucleotide
aaattgtgtgtaagtcatgtt

SEQ ID NO: 122 - DNA, 20 bp, Artificial Sequence
  Synthetic Oligonucleotide
caattggtgctcttgcactt

SEQ ID NO: 123 - DNA, 20 bp, Artificial Sequence
  Synthetic Oligonucleotide
gaattggctatctttggtct

SEQ ID NO: 124 - DNA, 20 bp, Artificial Sequence
  Synthetic Oligonucleotide
caattgacggtcttccgttt

SEQ ID NO: 125 - DNA, 21 bp, Artificial Sequence
  Synthetic Oligonucleotide
caatttttggtaagttcgggt

SEQ ID NO: 126 - DNA, 20 bp, Artificial Sequence
  Synthetic Oligonucleotide
aaattgctgttcttacagtt

SEQ ID NO: 127 - DNA, 21 bp, Artificial Sequence
  Synthetic Oligonucleotide
gaattgttagtaagtttggct

SEQ ID NO: 128 - DNA, 20 bp, Artificial Sequence
  Synthetic Oligonucleotide
gaattgtggctcttgttgct

SEQ ID NO: 129 - DNA, 20 bp, Artificial Sequence
  Synthetic Oligonucleotide
caattacttttcttaaggtt

SEQ ID NO: 130 - DNA, 21 bp, Artificial Sequence
  Synthetic Oligonucleotide
caattgggactaagtgtcctt

SEQ ID NO: 131 - DNA, 21 bp, Artificial Sequence
  Synthetic Oligonucleotide
gaattcctgttaagtgcaggt

SEQ ID NO: 132 - DNA, 20 bp, Artificial Sequence
  Synthetic Oligonucleotide
aaatttggtgtctttgttat

SEQ ID NO: 133 - DNA, 21 bp, Artificial Sequence
  Synthetic Oligonucleotide
caattgtttgtaagttgggct

SEQ ID NO: 134 - DNA, 20 bp, Artificial Sequence
  Synthetic Oligonucleotide
caattggttgtcttcaacct

SEQ ID NO: 135 - DNA, 21 bp, Artificial Sequence
  Synthetic Oligonucleotide
caattaaccctaagtgggttt

SEQ ID NO: 136 - DNA, 20 bp, Artificial Sequence
  Synthetic Oligonucleotide
caattgatggtctttcgtct

SEQ ID NO: 137 - DNA, 20 bp, Artificial Sequence
  Synthetic Oligonucleotide
gaattgcgtctcttggtgct

SEQ ID NO: 138 - DNA, 21 bp, Artificial Sequence
  Synthetic Oligonucleotide
aaatttcgcgtaagtcgtggt

SEQ ID NO: 139 - DNA, 21 bp, Artificial Sequence
  Synthetic Oligonucleotide
caattttgattaagtattaat

SEQ ID NO: 140 - DNA, 20 bp, Artificial Sequence
  Synthetic Oligonucleotide
caatttctggtcttctggat

SEQ ID NO: 141 - DNA, 21 bp, Artificial Sequence
  Synthetic Oligonucleotide
caattggcactaagtgtgcct

SEQ ID NO: 142 - DNA, 21 bp, Artificial Sequence
  Synthetic Oligonucleotide
gaatttcgggtaagtctcggt

SEQ ID NO: 143 - DNA, 21 bp, Artificial Sequence
  Synthetic Oligonucleotide
caattgtccttaagtagggtt

SEQ ID NO: 144 - DNA, 21 bp, Artificial Sequence
  Synthetic Oligonucleotide
caattaaacgtaagtcgtttt

SEQ ID NO: 145 - DNA, 21 bp, Artificial Sequence
  Synthetic Oligonucleotide
aaattcggtctaagtggccgt

SEQ ID NO: 146 - DNA, 20 bp, Artificial Sequence
  Synthetic Oligonucleotide
caatttcccgtctttggggt

SEQ ID NO: 147 - DNA, 20 bp, Artificial Sequence
  Synthetic Oligonucleotide
caattcgtcttcttagatgt

SEQ ID NO: 148 - DNA, 20 bp, Artificial Sequence
  Synthetic Oligonucleotide
caattactgatcttttagtt

SEQ ID NO: 149 - DNA, 21 bp, Artificial Sequence
  Synthetic Oligonucleotide
caattttcggtaagttcgaat

SEQ ID NO: 150 - DNA, 20 bp, Artificial Sequence
  Synthetic Oligonucleotide
caattgggtgtcttcattct

SEQ ID NO: 151 - DNA, 20 bp, Artificial Sequence
  Synthetic Oligonucleotide
caattacgggtctttctgtt

SEQ ID NO: 152 - DNA, 21 bp, Artificial Sequence
  Synthetic Oligonucleotide
caattagggataagttccctt

SEQ ID NO: 153 - DNA, 21 bp, Artificial Sequence
  Synthetic Oligonucleotide
caattaggactaagtgttctt

SEQ ID NO: 154 - DNA, 20 bp, Artificial Sequence
  Synthetic Oligonucleotide
aaattacctgtctttaggtt

SEQ ID NO: 155 - DNA, 20 bp, Artificial Sequence
  Synthetic Oligonucleotide
aaattggccgtcttcggtct

SEQ ID NO: 156 - DNA, 20 bp, Artificial Sequence
  Synthetic Oligonucleotide
caattatgggtctttctgtt

SEQ ID NO: 157 - DNA, 20 bp, Artificial Sequence
  Synthetic Oligonucleotide
caattagacgtcttcgtctt

SEQ ID NO: 158 - DNA, 20 bp, Artificial Sequence
  Synthetic Oligonucleotide
gaattatgcatctttgcgtt

SEQ ID NO: 159 - DNA, 20 bp, Artificial Sequence
  Synthetic Oligonucleotide
caattcctgttcttgcgggt

SEQ ID NO: 160 - DNA, 20 bp, Artificial Sequence
  Synthetic Oligonucleotide
caattcggcttcttggctgt

SEQ ID NO: 161 - DNA, 20 bp, Artificial Sequence
  Synthetic Oligonucleotide
aaattgtgtctcttgatgct

SEQ ID NO: 162 - DNA, 20 bp, Artificial Sequence
  Synthetic Oligonucleotide
caattctgtgtctttgcggt

SEQ ID NO: 163 - DNA, 20 bp, Artificial Sequence
  Synthetic Oligonucleotide
caattggttctcttggatct

SEQ ID NO: 164 - DNA, 20 bp, Artificial Sequence
  Synthetic Oligonucleotide
gaattgcacgtctttgtgct

SEQ ID NO: 165 - DNA, 20 bp, Artificial Sequence
  Synthetic Oligonucleotide
caattgtgtctcttggtact

SEQ ID NO: 166 - DNA, 20 bp, Artificial Sequence
  Synthetic Oligonucleotide
caatttgcgctcttgtgtgt

SEQ ID NO: 167 - DNA, 21 bp, Artificial Sequence
  Synthetic Oligonucleotide
caattgtgtataagttgtgct

SEQ ID NO: 168 - DNA, 20 bp, Artificial Sequence
  Synthetic Oligonucleotide
caattattgctcttgtggtt

SEQ ID NO: 169 - DNA, 20 bp, Artificial Sequence
  Synthetic Oligonucleotide
caatttcccgtcttcgggat

SEQ ID NO: 170 - DNA, 21 bp, Artificial Sequence
  Synthetic Oligonucleotide
gaattttcgttaagtgtgggt

SEQ ID NO: 171 - DNA, 20 bp, Artificial Sequence
  Synthetic Oligonucleotide
gaattacggctcttgtcgtt

SEQ ID NO: 172 - DNA, 20 bp, Artificial Sequence
  Synthetic Oligonucleotide
caattggcgttcttatgcct

SEQ ID NO: 173 - DNA, 21 bp, Artificial Sequence
  Synthetic Oligonucleotide
caattgttggtaagtccaact

SEQ ID NO: 174 - DNA, 21 bp, Artificial Sequence
  Synthetic Oligonucleotide
caatttcaggtaagtcctggt

SEQ ID NO: 175 - DNA, 20 bp, Artificial Sequence
  Synthetic Oligonucleotide
caattaggattcttgttttt

SEQ ID NO: 176 - DNA, 21 bp, Artificial Sequence
  Synthetic Oligonucleotide
caattgtgcgtaagttgcgct

SEQ ID NO: 177 - DNA, 20 bp, Artificial Sequence
  Synthetic Oligonucleotide
caattggtcctcttggacct

SEQ ID NO: 178 - DNA, 21 bp, Artificial Sequence
  Synthetic Oligonucleotide
caattgcgagtaagttttgct

SEQ ID NO: 179 - DNA, 20 bp, Artificial Sequence
  Synthetic Oligonucleotide
caattgtgcgtctttgtgtt

SEQ ID NO: 180 - DNA, 20 bp, Artificial Sequence
  Synthetic Oligonucleotide
caattgttgttcttgcaact

SEQ ID NO: 181 - DNA, 20 bp, Artificial Sequence
  Synthetic Oligonucleotide
gaattgcccttcttggggtt

SEQ ID NO: 182 - DNA, 21 bp, Artificial Sequence
  Synthetic Oligonucleotide
caattccttctaagtgaaggt

SEQ ID NO: 183 - DNA, 21 bp, Artificial Sequence
  Synthetic Oligonucleotide
caattgtcggtaagtctggtt

SEQ ID NO: 184 - DNA, 21 bp, Artificial Sequence
  Synthetic Oligonucleotide
caattagggataagttccttt

SEQ ID NO: 185 - DNA, 20 bp, Artificial Sequence
  Synthetic Oligonucleotide
gaattgcatgtcttcatgtt

SEQ ID NO: 186 - DNA, 20 bp, Artificial Sequence
  Synthetic Oligonucleotide
caattaggtttcttgacctt

SEQ ID NO: 187 - DNA, 20 bp, Artificial Sequence
  Synthetic Oligonucleotide
caattatgcttcttagtatt

SEQ ID NO: 188 - DNA, 20 bp, Artificial Sequence
  Synthetic Oligonucleotide
caatttcgtgtctttgtggt

SEQ ID NO: 189 - DNA, 20 bp, Artificial Sequence
  Synthetic Oligonucleotide
caattttcgctcttgcgggt

SEQ ID NO: 190 - DNA, 21 bp, Artificial Sequence
  Synthetic Oligonucleotide
caattatcgttaagtgcggtt

SEQ ID NO: 191 - DNA, 20 bp, Artificial Sequence
  Synthetic Oligonucleotide
caattagtgatcttttactt

SEQ ID NO: 192 - DNA, 20 bp, Artificial Sequence
  Synthetic Oligonucleotide
caattgttcgtcttcgagct

SEQ ID NO: 193 - DNA, 21 bp, Artificial Sequence
  Synthetic Oligonucleotide
caattagtggtaagtccgttt

SEQ ID NO: 194 - DNA, 21 bp, Artificial Sequence
  Synthetic Oligonucleotide
caattctggctaagtgccggt

SEQ ID NO: 195 - DNA, 20 bp, Artificial Sequence
  Synthetic Oligonucleotide
caattgttgctcttgtggct

SEQ ID NO: 196 - DNA, 21 bp, Artificial Sequence
  Synthetic Oligonucleotide
caatttcatgtaagtcatggt

SEQ ID NO: 197 - DNA, 21 bp, Artificial Sequence
  Synthetic Oligonucleotide
caattatttgtaagtcaggtt

SEQ ID NO: 198 - DNA, 21 bp, Artificial Sequence
  Synthetic Oligonucleotide
caattgttgctaagtgcaatt

SEQ ID NO: 199 - DNA, 20 bp, Artificial Sequence
  Synthetic Oligonucleotide
caattgggtttcttagttct

SEQ ID NO: 200 - DNA, 21 bp, Artificial Sequence
  Synthetic Oligonucleotide
caattagctctaagtgggttt

SEQ ID NO: 201 - DNA, 20 bp, Artificial Sequence
  Synthetic Oligonucleotide
caattgcttatctttaagct

SEQ ID NO: 202 - DNA, 20 bp, Artificial Sequence
  Synthetic Oligonucleotide
caatttacattcttgtgtgt

SEQ ID NO: 203 - DNA, 20 bp, Artificial Sequence
  Synthetic Oligonucleotide
caatttcagttcttgctgat

SEQ ID NO: 204 - DNA, 20 bp, Artificial Sequence
  Synthetic Oligonucleotide
caattggcgttcttgtgctt

SEQ ID NO: 205 - DNA, 21 bp, Artificial Sequence
  Synthetic Oligonucleotide
gaattgtgcgtaagttgcgtt

SEQ ID NO: 206 - DNA, 20 bp, Artificial Sequence
  Synthetic Oligonucleotide
caattttatttcttgatgat

SEQ ID NO: 207 - DNA, 21 bp, Artificial Sequence
  Synthetic Oligonucleotide
caattataattaagtgttatt

SEQ ID NO: 208 - DNA, 21 bp, Artificial Sequence
  Synthetic Oligonucleotide
caattgcgcataagttgtgtt

SEQ ID NO: 209 - DNA, 20 bp, Artificial Sequence
  Synthetic Oligonucleotide
caattggtgatctttcgcct

SEQ ID NO: 210 - DNA, 20 bp, Artificial Sequence
  Synthetic Oligonucleotide
caattgtgtgtcttcgtgct

SEQ ID NO: 211 - DNA, 21 bp, Artificial Sequence
  Synthetic Oligonucleotide
caattattgctaagtgcaatt

SEQ ID NO: 212 - DNA, 20 bp, Artificial Sequence
  Synthetic Oligonucleotide
caatttgctgtcttcagtgt

SEQ ID NO: 213 - DNA, 20 bp, Artificial Sequence
  Synthetic Oligonucleotide
caattgatgttcttgcgtct

SEQ ID NO: 214 - DNA, 21 bp, Artificial Sequence
  Synthetic Oligonucleotide
caattgttgataagttcgact

SEQ ID NO: 215 - DNA, 20 bp, Artificial Sequence
  Synthetic Oligonucleotide
gaattcgttctcttgagcgt

SEQ ID NO: 216 - DNA, 20 bp, Artificial Sequence
  Synthetic Oligonucleotide
caattcgttgtctttgacgt

SEQ ID NO: 217 - DNA, 20 bp, Artificial Sequence
  Synthetic Oligonucleotide
caatttcttgtcttcggggt

SEQ ID NO: 218 - DNA, 21 bp, Artificial Sequence
  Synthetic Oligonucleotide
caatttggtataagttgttgt

SEQ ID NO: 219 - DNA, 20 bp, Artificial Sequence
  Synthetic Oligonucleotide
caattgagcgtcttcgctct

SEQ ID NO: 220 - DNA, 21 bp, Artificial Sequence
  Synthetic Oligonucleotide
caattaggtctaagtgacctt

SEQ ID NO: 221 - DNA, 20 bp, Artificial Sequence
  Synthetic Oligonucleotide
caattgtgcttcttggtgtt

SEQ ID NO: 222 - DNA, 21 bp, Artificial Sequence
  Synthetic Oligonucleotide
caattcgggttaagtgttcgt

SEQ ID NO: 223 - DNA, 20 bp, Artificial Sequence
  Synthetic Oligonucleotide
caattttgggtcttcctggt

SEQ ID NO: 224 - DNA, 21 bp, Artificial Sequence
  Synthetic Oligonucleotide
gaatttgtggtaagttcgcgt

SEQ ID NO: 225 - DNA, 21 bp, Artificial Sequence
  Synthetic Oligonucleotide
caattagatctaagtgatctt

SEQ ID NO: 226 - DNA, 21 bp, Artificial Sequence
  Synthetic Oligonucleotide
caattgcggttaagtactgct

SEQ ID NO: 227 - DNA, 21 bp, Artificial Sequence
  Synthetic Oligonucleotide
caattgcgcgtaagttgtgtt

SEQ ID NO: 228 - DNA, 20 bp, Artificial Sequence
  Synthetic Oligonucleotide
caattgtagttcttgctact

SEQ ID NO: 229 - DNA, 20 bp, Artificial Sequence
  Synthetic Oligonucleotide
gaattggcgttcttacgtct

SEQ ID NO: 230 - DNA, 21 bp, Artificial Sequence
  Synthetic Oligonucleotide
caattattcttaagtggggtt

SEQ ID NO: 231 - DNA, 21 bp, Artificial Sequence
  Synthetic Oligonucleotide
caattcgctgtaagtcagtgt

SEQ ID NO: 232 - DNA, 21 bp, Artificial Sequence
  Synthetic Oligonucleotide
caatttgtgctaagtgcgcat

SEQ ID NO: 233 - DNA, 20 bp, Artificial Sequence
  Synthetic Oligonucleotide
gaattccgtttcttgacggt

SEQ ID NO: 234 - DNA, 21 bp, Artificial Sequence
  Synthetic Oligonucleotide
caattgcgactaagtgtcgtt

SEQ ID NO: 235 - DNA, 20 bp, Artificial Sequence
  Synthetic Oligonucleotide
caattggggttcttatccct

SEQ ID NO: 236 - DNA, 20 bp, Artificial Sequence
  Synthetic Oligonucleotide
caattcgggctcttgctcgt

SEQ ID NO: 237 - DNA, 20 bp, Artificial Sequence
  Synthetic Oligonucleotide
caattcatcctcttgggtgt

SEQ ID NO: 238 - DNA, 21 bp, Artificial Sequence
  Synthetic Oligonucleotide
caattggctctaagtgagtct

SEQ ID NO: 239 - DNA, 21 bp, Artificial Sequence
  Synthetic Oligonucleotide
aaatttcgggtaagtctcggt

SEQ ID NO: 240 - DNA, 20 bp, Artificial Sequence
  Synthetic Oligonucleotide
caattgcgactcttgttgtt

SEQ ID NO: 241 - DNA, 20 bp, Artificial Sequence
  Synthetic Oligonucleotide
caattggtcgtctttgattt

SEQ ID NO: 242 - DNA, 21 bp, Artificial Sequence
  Synthetic Oligonucleotide
caattcctgataagtttgggt

SEQ ID NO: 243 - DNA, 21 bp, Artificial Sequence
  Synthetic Oligonucleotide
caattgtgcataagttgtgtt

SEQ ID NO: 244 - DNA, 21 bp, Artificial Sequence
  Synthetic Oligonucleotide
caattgtgcgtaagtcgcgtt

SEQ ID NO: 245 - DNA, 20 bp, Artificial Sequence
  Synthetic Oligonucleotide
caattggcgttcttatgtct

SEQ ID NO: 246 - DNA, 20 bp, Artificial Sequence
  Synthetic Oligonucleotide
caattaagcatctttgcttt

SEQ ID NO: 247 - DNA, 20 bp, Artificial Sequence
  Synthetic Oligonucleotide
caattatggttcttgccgtt

SEQ ID NO: 248 - DNA, 21 bp, Artificial Sequence
  Synthetic Oligonucleotide
gaattgtgcctaagtggcgtt

SEQ ID NO: 249 - DNA, 21 bp, Artificial Sequence
  Synthetic Oligonucleotide
caattctctgtaagtcagagt

SEQ ID NO: 250 - DNA, 21 bp, Artificial Sequence
  Synthetic Oligonucleotide
caattcgtgttaagtgtgtgt

SEQ ID NO: 251 - DNA, 21 bp, Artificial Sequence
  Synthetic Oligonucleotide
caattcgctttaagtgagtgt

SEQ ID NO: 252 - DNA, 21 bp, Artificial Sequence
  Synthetic Oligonucleotide
caattctacctaagtggtggt

SEQ ID NO: 253 - DNA, 20 bp, Artificial Sequence
  Synthetic Oligonucleotide
caattattcttcttagagtt

SEQ ID NO: 254 - DNA, 20 bp, Artificial Sequence
  Synthetic Oligonucleotide
caattagtattcttatgctt

SEQ ID NO: 255 - DNA, 21 bp, Artificial Sequence
  Synthetic Oligonucleotide
caattgcgtttaagtgatgct

SEQ ID NO: 256 - DNA, 21 bp, Artificial Sequence
  Synthetic Oligonucleotide
caattggacgtaagtcgtcct

SEQ ID NO: 257 - DNA, 20 bp, Artificial Sequence
  Synthetic Oligonucleotide
caattgagagtcttttcttt

SEQ ID NO: 258 - DNA, 20 bp, Artificial Sequence
  Synthetic Oligonucleotide
caattcgtgttcttgtgtgt

SEQ ID NO: 259 - DNA, 21 bp, Artificial Sequence
  Synthetic Oligonucleotide
caattacttttaagtggagtt

SEQ ID NO: 260 - DNA, 20 bp, Artificial Sequence
  Synthetic Oligonucleotide
caattatcgctcttgcggtt

SEQ ID NO: 261 - DNA, 20 bp, Artificial Sequence
  Synthetic Oligonucleotide
caattggtactcttgtgttt

SEQ ID NO: 262 - DNA, 21 bp, Artificial Sequence
  Synthetic Oligonucleotide
caattacgtgtaagtcacgtt

SEQ ID NO: 263 - DNA, 20 bp, Artificial Sequence
  Synthetic Oligonucleotide
caatttgtgatctttcgtat

SEQ ID NO: 264 - DNA, 20 bp, Artificial Sequence
  Synthetic Oligonucleotide
caattgtgcctcttggtact

SEQ ID NO: 265 - DNA, 20 bp, Artificial Sequence
  Synthetic Oligonucleotide
caatttatgctcttgcgtat

SEQ ID NO: 266 - DNA, 21 bp, Artificial Sequence
  Synthetic Oligonucleotide
aaattcggtctaagtgatcgt

SEQ ID NO: 267 - DNA, 21 bp, Artificial Sequence
  Synthetic Oligonucleotide
caatttgggataagttcccat

SEQ ID NO: 268 - DNA, 20 bp, Artificial Sequence
  Synthetic Oligonucleotide
caattttggctcttgtcgat

SEQ ID NO: 269 - DNA, 21 bp, Artificial Sequence
  Synthetic Oligonucleotide
caatttcgagtaagtctcggt

SEQ ID NO: 270 - DNA, 20 bp, Artificial Sequence
  Synthetic Oligonucleotide
caattcaacgtcttcgttgt

SEQ ID NO: 271 - DNA, 20 bp, Artificial Sequence
  Synthetic Oligonucleotide
caattggctgtctttagcct

SEQ ID NO: 272 - DNA, 21 bp, Artificial Sequence
  Synthetic Oligonucleotide
caattggtgctaagtgtgcct

SEQ ID NO: 273 - DNA, 21 bp, Artificial Sequence
  Synthetic Oligonucleotide
caattacgtgtaagtcgtgtt

SEQ ID NO: 274 - DNA, 20 bp, Artificial Sequence
  Synthetic Oligonucleotide
caattggttgtcttcagcct

SEQ ID NO: 275 - DNA, 20 bp, Artificial Sequence
  Synthetic Oligonucleotide
caatttgggttcttgctcgt

SEQ ID NO: 276 - DNA, 21 bp, Artificial Sequence
  Synthetic Oligonucleotide
caattgggggtaagtcttctt

SEQ ID NO: 277 - DNA, 20 bp, Artificial Sequence
  Synthetic Oligonucleotide
caatttcgtctcttgacggt

SEQ ID NO: 278 - DNA, 21 bp, Artificial Sequence
  Synthetic Oligonucleotide
caattgtgcttaagtagcgtt

SEQ ID NO: 279 - DNA, 20 bp, Artificial Sequence
  Synthetic Oligonucleotide
caatttaccttcttgggtgt

SEQ ID NO: 280 - DNA, 21 bp, Artificial Sequence
  Synthetic Oligonucleotide
caattcggcataagttgtcgt

SEQ ID NO: 281 - DNA, 21 bp, Artificial Sequence
  Synthetic Oligonucleotide
caatttatggtaagtttatgt

SEQ ID NO: 282 - DNA, 20 bp, Artificial Sequence
  Synthetic Oligonucleotide
caattgattgtctttgatct

SEQ ID NO: 283 - DNA, 21 bp, Artificial Sequence
  Synthetic Oligonucleotide
gaattgcgactaagtgtcgct

SEQ ID NO: 284 - DNA, 20 bp, Artificial Sequence
  Synthetic Oligonucleotide
caattagttttcttggattt

SEQ ID NO: 285 - DNA, 21 bp, Artificial Sequence
  Synthetic Oligonucleotide
caattgcgtctaagtgacgtt

SEQ ID NO: 286 - DNA, 20 bp, Artificial Sequence
  Synthetic Oligonucleotide
caattaagtttcttggtttt

SEQ ID NO: 287 - DNA, 21 bp, Artificial Sequence
  Synthetic Oligonucleotide
caattggtgttaagtgcattt

SEQ ID NO: 288 - DNA, 21 bp, Artificial Sequence
  Synthetic Oligonucleotide
caattactgataagtttggtt

SEQ ID NO: 289 - DNA, 20 bp, Artificial Sequence
  Synthetic Oligonucleotide
caattggacatctttgtcct

SEQ ID NO: 290 - DNA, 20 bp, Artificial Sequence
  Synthetic Oligonucleotide
caatttgttttcttaaacgt

SEQ ID NO: 291 - DNA, 20 bp, Artificial Sequence
  Synthetic Oligonucleotide
caatttgacctcttggtcat

SEQ ID NO: 292 - DNA, 20 bp, Artificial Sequence
  Synthetic Oligonucleotide
caattccacgtcttcgtggt

SEQ ID NO: 293 - DNA, 21 bp, Artificial Sequence
  Synthetic Oligonucleotide
aaattcatgttaagtacgtgt

SEQ ID NO: 294 - DNA, 20 bp, Artificial Sequence
  Synthetic Oligonucleotide
caattttacgtcttcgtgat

SEQ ID NO: 295 - DNA, 21 bp, Artificial Sequence
  Synthetic Oligonucleotide
caattgacgctaagtgcgtct

SEQ ID NO: 296 - DNA, 20 bp, Artificial Sequence
  Synthetic Oligonucleotide
caattcgatgtctttgtcgt

SEQ ID NO: 297 - DNA, 20 bp, Artificial Sequence
  Synthetic Oligonucleotide
caattccgtgtctttgcggt

SEQ ID NO: 298 - DNA, 21 bp, Artificial Sequence
  Synthetic Oligonucleotide
caattgcggttaagtgccgct

SEQ ID NO: 299 - DNA, 20 bp, Artificial Sequence
  Synthetic Oligonucleotide
caattggtgttcttgcgctt

SEQ ID NO: 300 - DNA, 20 bp, Artificial Sequence
  Synthetic Oligonucleotide
caattcatcgtctttgatgt

SEQ ID NO: 301 - DNA, 21 bp, Artificial Sequence
  Synthetic Oligonucleotide
caatttttgttaagtgcgagt

SEQ ID NO: 302 - DNA, 21 bp, Artificial Sequence
  Synthetic Oligonucleotide
caattaggcttaagtggcctt

SEQ ID NO: 303 - DNA, 21 bp, Artificial Sequence
  Synthetic Oligonucleotide
caattggggctaagtgtctct

SEQ ID NO: 304 - DNA, 20 bp, Artificial Sequence
  Synthetic Oligonucleotide
caattggctttcttaggcct

SEQ ID NO: 305 - DNA, 20 bp, Artificial Sequence
  Synthetic Oligonucleotide
caattacgcgtcttcgtgtt

SEQ ID NO: 306 - DNA, 20 bp, Artificial Sequence
  Synthetic Oligonucleotide
gaattgcgggtcttctcgct

SEQ ID NO: 307 - DNA, 20 bp, Artificial Sequence
  Synthetic Oligonucleotide
caattctgcgtcttcgtagt

SEQ ID NO: 308 - DNA, 21 bp, Artificial Sequence
  Synthetic Oligonucleotide
caattcgcggtaagtccgtgt

SEQ ID NO: 309 - DNA, 21 bp, Artificial Sequence
  Synthetic Oligonucleotide
caattacgcgtaagttgcgtt

SEQ ID NO: 310 - DNA, 21 bp, Artificial Sequence
  Synthetic Oligonucleotide
caattaagtgtaagtcatttt

SEQ ID NO: 311 - DNA, 21 bp, Artificial Sequence
  Synthetic Oligonucleotide
caatttggtttaagtgatcgt

SEQ ID NO: 312 - DNA, 20 bp, Artificial Sequence
  Synthetic Oligonucleotide
caatttgagttcttgttcgt

SEQ ID NO: 313 - DNA, 21 bp, Artificial Sequence
  Synthetic Oligonucleotide
caattgtcgttaagtgcgact

SEQ ID NO: 314 - DNA, 21 bp, Artificial Sequence
  Synthetic Oligonucleotide
caattgtttttaagtggggct

SEQ ID NO: 315 - DNA, 21 bp, Artificial Sequence
  Synthetic Oligonucleotide
caatttcacgtaagttgtgat

SEQ ID NO: 316 - DNA, 21 bp, Artificial Sequence
  Synthetic Oligonucleotide
caatttgtgataagttcacgt

SEQ ID NO: 317 - DNA, 21 bp, Artificial Sequence
  Synthetic Oligonucleotide
caatttcgtttaagtgatggt

SEQ ID NO: 318 - DNA, 20 bp, Artificial Sequence
  Synthetic Oligonucleotide
caatttttcgtctttgggat

SEQ ID NO: 319 - DNA, 20 bp, Artificial Sequence
  Synthetic Oligonucleotide
caattatccttcttagggtt

SEQ ID NO: 320 - DNA, 20 bp, Artificial Sequence
  Synthetic Oligonucleotide
caattcgcgatcttttgtgt

SEQ ID NO: 321 - DNA, 20 bp, Artificial Sequence
  Synthetic Oligonucleotide
caattaagtttcttggcttt

SEQ ID NO: 322 - DNA, 20 bp, Artificial Sequence
  Synthetic Oligonucleotide
caatttttggtcttccaaat

SEQ ID NO: 323 - DNA, 21 bp, Artificial Sequence
  Synthetic Oligonucleotide
caattcacgttaagtatgtgt

SEQ ID NO: 324 - DNA, 20 bp, Artificial Sequence
  Synthetic Oligonucleotide
caattgcttgtcttcgagct

SEQ ID NO: 325 - DNA, 21 bp, Artificial Sequence
  Synthetic Oligonucleotide
aaattgtgcgtaagtcgtgct

SEQ ID NO: 326 - DNA, 20 bp, Artificial Sequence
  Synthetic Oligonucleotide
caattgtgggtcttcctatt

SEQ ID NO: 327 - DNA, 20 bp, Artificial Sequence
  Synthetic Oligonucleotide
caatttgacgtcttcgtcat

SEQ ID NO: 328 - DNA, 21 bp, Artificial Sequence
  Synthetic Oligonucleotide
caatttggtgtaagtcatcgt

SEQ ID NO: 329 - DNA, 21 bp, Artificial Sequence
  Synthetic Oligonucleotide
caattgtcgttaagtacggtt

SEQ ID NO: 330 - DNA, 21 bp, Artificial Sequence
  Synthetic Oligonucleotide
caattgctggtaagtctagtt

SEQ ID NO: 331 - DNA, 20 bp, Artificial Sequence
  Synthetic Oligonucleotide
caattggtcctcttgggtct

SEQ ID NO: 332 - DNA, 20 bp, Artificial Sequence
  Synthetic Oligonucleotide
caattctgcgtcttcgtggt

SEQ ID NO: 333 - DNA, 20 bp, Artificial Sequence
  Synthetic Oligonucleotide
caattcttgttcttgtgagt

SEQ ID NO: 334 - DNA, 20 bp, Artificial Sequence
  Synthetic Oligonucleotide
caatttgccctcttgggcgt

SEQ ID NO: 335 - DNA, 20 bp, Artificial Sequence
  Synthetic Oligonucleotide
caattgggggtcttttccct

SEQ ID NO: 336 - DNA, 20 bp, Artificial Sequence
  Synthetic Oligonucleotide
caattgacgctcttgcgtct

SEQ ID NO: 337 - DNA, 21 bp, Artificial Sequence
  Synthetic Oligonucleotide
caatttgcgttaagtacgcat

SEQ ID NO: 338 - DNA, 20 bp, Artificial Sequence
  Synthetic Oligonucleotide
caatttcaagtctttttgat

SEQ ID NO: 339 - DNA, 20 bp, Artificial Sequence
  Synthetic Oligonucleotide
caattgcagttcttgttgct

SEQ ID NO: 340 - DNA, 21 bp, Artificial Sequence
  Synthetic Oligonucleotide
caattgtatgtaagtcgtgct

SEQ ID NO: 341 - DNA, 21 bp, Artificial Sequence
  Synthetic Oligonucleotide
caattgggggtaagtccttct

SEQ ID NO: 342 - DNA, 20 bp, Artificial Sequence
  Synthetic Oligonucleotide
caattatggttcttaccgtt

SEQ ID NO: 343 - DNA, 20 bp, Artificial Sequence
  Synthetic Oligonucleotide
caattttgtgtcttcacgat

SEQ ID NO: 344 - DNA, 20 bp, Artificial Sequence
  Synthetic Oligonucleotide
caattacttatctttgagtt

SEQ ID NO: 345 - DNA, 21 bp, Artificial Sequence
  Synthetic Oligonucleotide
caattatgggtaagtctcatt

SEQ ID NO: 346 - DNA, 21 bp, Artificial Sequence
  Synthetic Oligonucleotide
aaattcgtgctaagtgtgcgt

SEQ ID NO: 347 - DNA, 20 bp, Artificial Sequence
  Synthetic Oligonucleotide
caattgtgcctcttggtgct

SEQ ID NO: 348 - DNA, 21 bp, Artificial Sequence
  Synthetic Oligonucleotide
caattgtgtgtaagtcgcgct

SEQ ID NO: 349 - DNA, 21 bp, Artificial Sequence
  Synthetic Oligonucleotide
caattttggctaagtgctaat

SEQ ID NO: 350 - DNA, 20 bp, Artificial Sequence
  Synthetic Oligonucleotide
caattagccttcttgggttt

SEQ ID NO: 351 - DNA, 20 bp, Artificial Sequence
  Synthetic Oligonucleotide
caattacgtgtcttcgtgtt

SEQ ID NO: 352 - DNA, 20 bp, Artificial Sequence
  Synthetic Oligonucleotide
caattgttgctcttgcgatt

SEQ ID NO: 353 - DNA, 20 bp, Artificial Sequence
  Synthetic Oligonucleotide
caattcgtgttcttacgcgt

SEQ ID NO: 354 - DNA, 20 bp, Artificial Sequence
  Synthetic Oligonucleotide
caattggttctcttgggcct

SEQ ID NO: 355 - DNA, 20 bp, Artificial Sequence
  Synthetic Oligonucleotide
caattaacgttcttgcgttt

SEQ ID NO: 356 - DNA, 20 bp, Artificial Sequence
  Synthetic Oligonucleotide
caattagatttcttggtctt

SEQ ID NO: 357 - DNA, 21 bp, Artificial Sequence
  Synthetic Oligonucleotide
caattgccgctaagtgcggtt

SEQ ID NO: 358 - DNA, 20 bp, Artificial Sequence
  Synthetic Oligonucleotide
caattcggtatctttgtcgt

SEQ ID NO: 359 - DNA, 20 bp, Artificial Sequence
  Synthetic Oligonucleotide
caatttgcagtcttctgcat

SEQ ID NO: 360 - DNA, 20 bp, Artificial Sequence
  Synthetic Oligonucleotide
caatttaagttcttgtttgt

SEQ ID NO: 361 - DNA, 21 bp, Artificial Sequence
  Synthetic Oligonucleotide
caattgtttttaagtgaggct

SEQ ID NO: 362 - DNA, 20 bp, Artificial Sequence
  Synthetic Oligonucleotide
caattggttgtcttcagtct

SEQ ID NO: 363 - DNA, 21 bp, Artificial Sequence
  Synthetic Oligonucleotide
caatttgcgttaagtgcgcat

SEQ ID NO: 364 - DNA, 21 bp, Artificial Sequence
  Synthetic Oligonucleotide
caatttcggttaagtgtcggt

SEQ ID NO: 365 - DNA, 20 bp, Artificial Sequence
  Synthetic Oligonucleotide
caattggtcatctttgactt

SEQ ID NO: 366 - DNA, 20 bp, Artificial Sequence
  Synthetic Oligonucleotide
caattgcgtctcttggtgct

SEQ ID NO: 367 - DNA, 21 bp, Artificial Sequence
  Synthetic Oligonucleotide
caatttttgttaagtgtaggt

SEQ ID NO: 368 - DNA, 21 bp, Artificial Sequence
  Synthetic Oligonucleotide
caattgtgtgtaagttatgtt

SEQ ID NO: 369 - DNA, 20 bp, Artificial Sequence
  Synthetic Oligonucleotide
gaattgtgtatctttgcgct

SEQ ID NO: 370 - DNA, 20 bp, Artificial Sequence
  Synthetic Oligonucleotide
caattggacgtctttgtttt

SEQ ID NO: 371 - DNA, 21 bp, Artificial Sequence
  Synthetic Oligonucleotide
gaattcgcgctaagtgtgcgt

SEQ ID NO: 372 - DNA, 20 bp, Artificial Sequence
  Synthetic Oligonucleotide
caattacttttcttgaggtt

SEQ ID NO: 373 - DNA, 21 bp, Artificial Sequence
  Synthetic Oligonucleotide
caattccgggtaagtcttggt

SEQ ID NO: 374 - DNA, 21 bp, Artificial Sequence
  Synthetic Oligonucleotide
caattgaacctaagtggttct

SEQ ID NO: 375 - DNA, 21 bp, Artificial Sequence
  Synthetic Oligonucleotide
aaattggtgctaagtgcgcct

SEQ ID NO: 376 - DNA, 20 bp, Artificial Sequence
  Synthetic Oligonucleotide
caattgtggttcttactatt

SEQ ID NO: 377 - DNA, 20 bp, Artificial Sequence
  Synthetic Oligonucleotide
caatttctgatcttttgggt

SEQ ID NO: 378 - DNA, 21 bp, Artificial Sequence
  Synthetic Oligonucleotide
caattattgctaagtgcgatt

SEQ ID NO: 379 - DNA, 20 bp, Artificial Sequence
  Synthetic Oligonucleotide
caattttgcctcttggcaat

SEQ ID NO: 380 - DNA, 21 bp, Artificial Sequence
  Synthetic Oligonucleotide
caattgtggttaagtgctgtt

SEQ ID NO: 381 - DNA, 20 bp, Artificial Sequence
  Synthetic Oligonucleotide
caattgcgtctcttgatgct

SEQ ID NO: 382 - DNA, 20 bp, Artificial Sequence
  Synthetic Oligonucleotide
caatttggtgtctttatcgt

SEQ ID NO: 383 - DNA, 20 bp, Artificial Sequence
  Synthetic Oligonucleotide
caattgttggtcttccagtt

SEQ ID NO: 384 - DNA, 20 bp, Artificial Sequence
  Synthetic Oligonucleotide
caattggctgtctttggcct

SEQ ID NO: 385 - DNA, 20 bp, Artificial Sequence
  Synthetic Oligonucleotide
caattggctctcttgagtct

SEQ ID NO: 386 - DNA, 20 bp, Artificial Sequence
  Synthetic Oligonucleotide
caattacgggtcttcctgtt

SEQ ID NO: 387 - DNA, 20 bp, Artificial Sequence
  Synthetic Oligonucleotide
gaattagtgttcttgcgctt

SEQ ID NO: 388 - DNA, 20 bp, Artificial Sequence
  Synthetic Oligonucleotide
caatttgtcgtcttcggcat

SEQ ID NO: 389 - DNA, 21 bp, Artificial Sequence
  Synthetic Oligonucleotide
caattgcgtttaagtgacgct

SEQ ID NO: 390 - DNA, 20 bp, Artificial Sequence
  Synthetic Oligonucleotide
caattcctgatcttttaggt

SEQ ID NO: 391 - DNA, 21 bp, Artificial Sequence
  Synthetic Oligonucleotide
gaatttcggttaagtgctggt

SEQ ID NO: 392 - DNA, 20 bp, Artificial Sequence
  Synthetic Oligonucleotide
caattgggtatctttgctct

SEQ ID NO: 393 - DNA, 21 bp, Artificial Sequence
  Synthetic Oligonucleotide
caattggctctaagtgagttt

SEQ ID NO: 394 - DNA, 21 bp, Artificial Sequence
  Synthetic Oligonucleotide
caatttgtgttaagtatacat

SEQ ID NO: 395 - DNA, 20 bp, Artificial Sequence
  Synthetic Oligonucleotide
caattgcgtgtctttatgtt

SEQ ID NO: 396 - DNA, 20 bp, Artificial Sequence
  Synthetic Oligonucleotide
caattgttgttcttacggct

SEQ ID NO: 397 - DNA, 21 bp, Artificial Sequence
  Synthetic Oligonucleotide
caattggggttaagtgccctt

SEQ ID NO: 398 - DNA, 21 bp, Artificial Sequence
  Synthetic Oligonucleotide
caattgcgtttaagtgacgtt

SEQ ID NO: 399 - DNA, 21 bp, Artificial Sequence
  Synthetic Oligonucleotide
caattgcatgtaagtcgtgtt

SEQ ID NO: 400 - DNA, 20 bp, Artificial Sequence
  Synthetic Oligonucleotide
caattggcggtctttcgcct

SEQ ID NO: 401 - DNA, 20 bp, Artificial Sequence
  Synthetic Oligonucleotide
caattcaggctcttgtctgt

SEQ ID NO: 402 - DNA, 20 bp, Artificial Sequence
  Synthetic Oligonucleotide
gaattcctgctcttgtaggt

SEQ ID NO: 403 - DNA, 21 bp, Artificial Sequence
  Synthetic Oligonucleotide
caattcgcattaagtgtgcgt

SEQ ID NO: 404 - DNA, 20 bp, Artificial Sequence
  Synthetic Oligonucleotide
caattactggtcttctagtt

SEQ ID NO: 405 - DNA, 21 bp, Artificial Sequence
  Synthetic Oligonucleotide
caattggctttaagtgagttt

SEQ ID NO: 406 - DNA, 20 bp, Artificial Sequence
  Synthetic Oligonucleotide
aaatttgtcatctttggtgt

SEQ ID NO: 407 - DNA, 20 bp, Artificial Sequence
  Synthetic Oligonucleotide
caattggtgttcttatgctt

SEQ ID NO: 408 - DNA, 21 bp, Artificial Sequence
  Synthetic Oligonucleotide
caatttgttgtaagtcgacat

SEQ ID NO: 409 - DNA, 20 bp, Artificial Sequence
  Synthetic Oligonucleotide
caattgtatctcttgatact

SEQ ID NO: 410 - DNA, 21 bp, Artificial Sequence
  Synthetic Oligonucleotide
caattttggttaagtgccggt

SEQ ID NO: 411 - DNA, 20 bp, Artificial Sequence
  Synthetic Oligonucleotide
caattggttttcttggactt

SEQ ID NO: 412 - DNA, 20 bp, Artificial Sequence
  Synthetic Oligonucleotide
caattgtgtgtcttcgtgtt

SEQ ID NO: 413 - DNA, 21 bp, Artificial Sequence
  Synthetic Oligonucleotide
caattatgcgtaagtcgtgtt

SEQ ID NO: 414 - DNA, 20 bp, Artificial Sequence
  Synthetic Oligonucleotide
caatttggcgtctttgtcgt

SEQ ID NO: 415 - DNA, 21 bp, Artificial Sequence
  Synthetic Oligonucleotide
caattgctcgtaagtcgagtt

SEQ ID NO: 416 - DNA, 20 bp, Artificial Sequence
  Synthetic Oligonucleotide
caattcgcaatcttttgcgt

SEQ ID NO: 417 - DNA, 21 bp, Artificial Sequence
  Synthetic Oligonucleotide
caattcggcttaagtagttgt

SEQ ID NO: 418 - DNA, 20 bp, Artificial Sequence
  Synthetic Oligonucleotide
caattcatgttcttacgtgt

SEQ ID NO: 419 - DNA, 21 bp, Artificial Sequence
  Synthetic Oligonucleotide
caattgtatctaagtgatact

SEQ ID NO: 420 - DNA, 20 bp, Artificial Sequence
  Synthetic Oligonucleotide
gaatttgcgttcttgcgtat

SEQ ID NO: 421 - DNA, 20 bp, Artificial Sequence
  Synthetic Oligonucleotide
caatttgcaatcttttgcgt

SEQ ID NO: 422 - DNA, 21 bp, Artificial Sequence
  Synthetic Oligonucleotide
aaattgtcgttaagtgcggtt

SEQ ID NO: 423 - DNA, 20 bp, Artificial Sequence
  Synthetic Oligonucleotide
caattagcgctcttgcgctt

SEQ ID NO: 424 - DNA, 20 bp, Artificial Sequence
  Synthetic Oligonucleotide
caatttaaggtcttccttat

SEQ ID NO: 425 - DNA, 21 bp, Artificial Sequence
  Synthetic Oligonucleotide
caattgcggttaagtgtcgtt

SEQ ID NO: 426 - DNA, 21 bp, Artificial Sequence
  Synthetic Oligonucleotide
caattatgtgtaagtcatgtt

SEQ ID NO: 427 - DNA, 21 bp, Artificial Sequence
  Synthetic Oligonucleotide
gaattccgactaagtgttggt

SEQ ID NO: 428 - DNA, 20 bp, Artificial Sequence
  Synthetic Oligonucleotide
caattcgtgatcttttgcgt

SEQ ID NO: 429 - DNA, 21 bp, Artificial Sequence
  Synthetic Oligonucleotide
caattcttcgtaagtcgaagt

SEQ ID NO: 430 - DNA, 20 bp, Artificial Sequence
  Synthetic Oligonucleotide
caattcgtgttcttatgcgt

SEQ ID NO: 431 - DNA, 21 bp, Artificial Sequence
  Synthetic Oligonucleotide
caattgcgcctaagtggtgct

SEQ ID NO: 432 - DNA, 20 bp, Artificial Sequence
  Synthetic Oligonucleotide
caattgcgtatctttgcgtt

SEQ ID NO: 433 - DNA, 20 bp, Artificial Sequence
  Synthetic Oligonucleotide
caattgtgtctcttgacgtt

SEQ ID NO: 434 - DNA, 20 bp, Artificial Sequence
  Synthetic Oligonucleotide
caattatgtctcttggtgtt

SEQ ID NO: 435 - DNA, 20 bp, Artificial Sequence
  Synthetic Oligonucleotide
caattccgcgtctttgtggt

SEQ ID NO: 436 - DNA, 20 bp, Artificial Sequence
  Synthetic Oligonucleotide
caattgtttatctttggact

SEQ ID NO: 437 - DNA, 20 bp, Artificial Sequence
  Synthetic Oligonucleotide
caattttgcgtcttcgtagt

SEQ ID NO: 438 - DNA, 21 bp, Artificial Sequence
  Synthetic Oligonucleotide
caattcaccgtaagttggtgt

SEQ ID NO: 439 - DNA, 21 bp, Artificial Sequence
  Synthetic Oligonucleotide
caattgcttgtaagtcaggct

SEQ ID NO: 440 - DNA, 20 bp, Artificial Sequence
  Synthetic Oligonucleotide
caattgcttttcttagggct

SEQ ID NO: 441 - DNA, 20 bp, Artificial Sequence
  Synthetic Oligonucleotide
aaattgtgcttcttggcgct

SEQ ID NO: 442 - DNA, 20 bp, Artificial Sequence
  Synthetic Oligonucleotide
aaattgttgctcttgcgact

SEQ ID NO: 443 - DNA, 20 bp, Artificial Sequence
  Synthetic Oligonucleotide
caattgcgtatctttgcgct

SEQ ID NO: 444 - DNA, 21 bp, Artificial Sequence
  Synthetic Oligonucleotide
caattggtgttaagtgcgttt

SEQ ID NO: 445 - DNA, 20 bp, Artificial Sequence
  Synthetic Oligonucleotide
caattgcgcatctttgcgtt

SEQ ID NO: 446 - DNA, 20 bp, Artificial Sequence
  Synthetic Oligonucleotide
caattatgtgtcttcgcgtt

SEQ ID NO: 447 - DNA, 20 bp, Artificial Sequence
  Synthetic Oligonucleotide
caattacgtatctttgcgtt

SEQ ID NO: 448 - DNA, 21 bp, Artificial Sequence
  Synthetic Oligonucleotide
caatttggtgtaagtcgtcgt

SEQ ID NO: 449 - DNA, 21 bp, Artificial Sequence
  Synthetic Oligonucleotide
caatttgttgtaagtcggcgt

SEQ ID NO: 450 - DNA, 21 bp, Artificial Sequence
  Synthetic Oligonucleotide
gaattagcgttaagtacgttt

SEQ ID NO: 451 - DNA, 21 bp, Artificial Sequence
  Synthetic Oligonucleotide
caatttccggtaagttcgggt

SEQ ID NO: 452 - DNA, 20 bp, Artificial Sequence
  Synthetic Oligonucleotide
caattcgttctcttgaacgt

SEQ ID NO: 453 - DNA, 20 bp, Artificial Sequence
  Synthetic Oligonucleotide
caattatgcatctttgtgtt

SEQ ID NO: 454 - DNA, 21 bp, Artificial Sequence
  Synthetic Oligonucleotide
caattgcgcctaagtggcgtt

SEQ ID NO: 455 - DNA, 20 bp, Artificial Sequence
  Synthetic Oligonucleotide
caattcgctatctttggcgt

SEQ ID NO: 456 - DNA, 21 bp, Artificial Sequence
  Synthetic Oligonucleotide
caattccgtgtaagtcgcggt

SEQ ID NO: 457 - DNA, 20 bp, Artificial Sequence
  Synthetic Oligonucleotide
caattgtgggtctttccgtt

SEQ ID NO: 458 - DNA, 20 bp, Artificial Sequence
  Synthetic Oligonucleotide
caatttgtggtcttttatat

SEQ ID NO: 459 - DNA, 20 bp, Artificial Sequence
  Synthetic Oligonucleotide
caattcatcgtcttcggtgt

SEQ ID NO: 460 - DNA, 21 bp, Artificial Sequence
  Synthetic Oligonucleotide
gaattccatgtaagttgtggt

SEQ ID NO: 461 - DNA, 21 bp, Artificial Sequence
  Synthetic Oligonucleotide
caattagacctaagtggtctt

SEQ ID NO: 462 - DNA, 20 bp, Artificial Sequence
  Synthetic Oligonucleotide
caattgtttgtctttgagct

SEQ ID NO: 463 - DNA, 20 bp, Artificial Sequence
  Synthetic Oligonucleotide
caattccgtctcttgacggt

SEQ ID NO: 464 - DNA, 20 bp, Artificial Sequence
  Synthetic Oligonucleotide
caattcgccgtcttcggtgt

SEQ ID NO: 465 - DNA, 21 bp, Artificial Sequence
  Synthetic Oligonucleotide
caatttgctataagttggtat

SEQ ID NO: 466 - DNA, 20 bp, Artificial Sequence
  Synthetic Oligonucleotide
caattgtgggtcttttcact

SEQ ID NO: 467 - DNA, 20 bp, Artificial Sequence
  Synthetic Oligonucleotide
caattgcacttcttggtgct

SEQ ID NO: 468 - DNA, 20 bp, Artificial Sequence
  Synthetic Oligonucleotide
caattcagagtcttctttgt

SEQ ID NO: 469 - DNA, 21 bp, Artificial Sequence
  Synthetic Oligonucleotide
caatttttgctaagtgtgggt

SEQ ID NO: 470 - DNA, 20 bp, Artificial Sequence
  Synthetic Oligonucleotide
gaattgttcgtcttcgagct

SEQ ID NO: 471 - DNA, 20 bp, Artificial Sequence
  Synthetic Oligonucleotide
caattcgctatctttagcgt

SEQ ID NO: 472 - DNA, 21 bp, Artificial Sequence
  Synthetic Oligonucleotide
caattgggtctaagtgatcct

SEQ ID NO: 473 - DNA, 20 bp, Artificial Sequence
  Synthetic Oligonucleotide
caattgttgttcttgtggct

SEQ ID NO: 474 - DNA, 20 bp, Artificial Sequence
  Synthetic Oligonucleotide
caattttgtgtcttcacggt

SEQ ID NO: 475 - DNA, 21 bp, Artificial Sequence
  Synthetic Oligonucleotide
caattcgttgtaagtcggtgt

SEQ ID NO: 476 - DNA, 21 bp, Artificial Sequence
  Synthetic Oligonucleotide
caattcgccttaagtaggcgt

SEQ ID NO: 477 - DNA, 20 bp, Artificial Sequence
  Synthetic Oligonucleotide
caatttttactcttgtgagt

SEQ ID NO: 478 - DNA, 20 bp, Artificial Sequence
  Synthetic Oligonucleotide
caatttggggtctttcccat

SEQ ID NO: 479 - DNA, 21 bp, Artificial Sequence
  Synthetic Oligonucleotide
caattcagtgtaagtcactgt

SEQ ID NO: 480 - DNA, 20 bp, Artificial Sequence
  Synthetic Oligonucleotide
caattggcgttcttacgctt

SEQ ID NO: 481 - DNA, 20 bp, Artificial Sequence
  Synthetic Oligonucleotide
caattaagattcttgttttt

SEQ ID NO: 482 - DNA, 20 bp, Artificial Sequence
  Synthetic Oligonucleotide
caattgacgttcttacgttt

SEQ ID NO: 483 - DNA, 21 bp, Artificial Sequence
  Synthetic Oligonucleotide
caattagatgtaagtcgtctt

SEQ ID NO: 484 - DNA, 21 bp, Artificial Sequence
  Synthetic Oligonucleotide
caatttcgactaagtgtcggt

SEQ ID NO: 485 - DNA, 21 bp, Artificial Sequence
  Synthetic Oligonucleotide
caattttgattaagtgttgat

SEQ ID NO: 486 - DNA, 20 bp, Artificial Sequence
  Synthetic Oligonucleotide
caattcgacgtcttcgtcgt

SEQ ID NO: 487 - DNA, 21 bp, Artificial Sequence
  Synthetic Oligonucleotide
caattgaacgtaagtcgttct

SEQ ID NO: 488 - DNA, 21 bp, Artificial Sequence
  Synthetic Oligonucleotide
caattggcactaagtgtgtct

SEQ ID NO: 489 - DNA, 21 bp, Artificial Sequence
  Synthetic Oligonucleotide
gaattcgccgtaagtcggtgt

SEQ ID NO: 490 - DNA, 20 bp, Artificial Sequence
  Synthetic Oligonucleotide
caattcgatgtcttcattgt

SEQ ID NO: 491 - DNA, 21 bp, Artificial Sequence
  Synthetic Oligonucleotide
caattctgtgtaagtcgcagt

SEQ ID NO: 492 - DNA, 20 bp, Artificial Sequence
  Synthetic Oligonucleotide
aaattccgcgtcttcgtggt

SEQ ID NO: 493 - DNA, 21 bp, Artificial Sequence
  Synthetic Oligonucleotide
gaattgagcctaagtggttct

SEQ ID NO: 494 - DNA, 20 bp, Artificial Sequence
  Synthetic Oligonucleotide
aaattgcgtctcttgacgtt

SEQ ID NO: 495 - DNA, 21 bp, Artificial Sequence
  Synthetic Oligonucleotide
caattggttttaagtggatct

SEQ ID NO: 496 - DNA, 20 bp, Artificial Sequence
  Synthetic Oligonucleotide
aaattcgctctcttgggtgt

SEQ ID NO: 497 - DNA, 20 bp, Artificial Sequence
  Synthetic Oligonucleotide
caatttacgttcttgcgtat

SEQ ID NO: 498 - DNA, 20 bp, Artificial Sequence
  Synthetic Oligonucleotide
caatttacgttcttacgtat

SEQ ID NO: 499 - DNA, 20 bp, Artificial Sequence
  Synthetic Oligonucleotide
caattgcctctcttggggct

SEQ ID NO: 500 - DNA, 21 bp, Artificial Sequence
  Synthetic Oligonucleotide
caattgtgggtaagtcccgct

SEQ ID NO: 501 - DNA, 21 bp, Artificial Sequence
  Synthetic Oligonucleotide
caattgtcggtaagttcggct

SEQ ID NO: 502 - DNA, 21 bp, Artificial Sequence
  Synthetic Oligonucleotide
caattggggttaagtgcccct

SEQ ID NO: 503 - DNA, 20 bp, Artificial Sequence
  Synthetic Oligonucleotide
caattagagttcttgttctt

SEQ ID NO: 504 - DNA, 20 bp, Artificial Sequence
  Synthetic Oligonucleotide
caattgtacgtcttcgtgct

SEQ ID NO: 505 - DNA, 21 bp, Artificial Sequence
  Synthetic Oligonucleotide
caatttacgttaagtacgtat

SEQ ID NO: 506 - DNA, 21 bp, Artificial Sequence
  Synthetic Oligonucleotide
caattcggcataagttgttgt

SEQ ID NO: 507 - DNA, 21 bp, Artificial Sequence
  Synthetic Oligonucleotide
caatttggtataagttgctgt

SEQ ID NO: 508 - DNA, 20 bp, Artificial Sequence
  Synthetic Oligonucleotide
caattacttgtcttcgagtt

SEQ ID NO: 509 - DNA, 20 bp, Artificial Sequence
  Synthetic Oligonucleotide
caattgccgctcttgtggct

SEQ ID NO: 510 - DNA, 20 bp, Artificial Sequence
  Synthetic Oligonucleotide
caattgtgtgtctttacgct

SEQ ID NO: 511 - DNA, 20 bp, Artificial Sequence
  Synthetic Oligonucleotide
caatttgtgctcttgcacgt

SEQ ID NO: 512 - DNA, 20 bp, Artificial Sequence
  Synthetic Oligonucleotide
gaattgtttgtcttcgaact

SEQ ID NO: 513 - DNA, 21 bp, Artificial Sequence
  Synthetic Oligonucleotide
caattgtggttaagtgccgtt

SEQ ID NO: 514 - DNA, 21 bp, Artificial Sequence
  Synthetic Oligonucleotide
gaattgaaggtaagtcctttt

SEQ ID NO: 515 - DNA, 20 bp, Artificial Sequence
  Synthetic Oligonucleotide
caattgtgtgtcttcacgct

SEQ ID NO: 516 - DNA, 20 bp, Artificial Sequence
  Synthetic Oligonucleotide
caattgcctgtctttaggct

SEQ ID NO: 517 - DNA, 20 bp, Artificial Sequence
  Synthetic Oligonucleotide
caatttttggtcttctggat

SEQ ID NO: 518 - DNA, 20 bp, Artificial Sequence
  Synthetic Oligonucleotide
caattattagtcttctagtt

SEQ ID NO: 519 - DNA, 20 bp, Artificial Sequence
  Synthetic Oligonucleotide
aaattggtcgtcttcgacct

SEQ ID NO: 520 - DNA, 20 bp, Artificial Sequence
  Synthetic Oligonucleotide
caattattagtcttttagtt

SEQ ID NO: 521 - DNA, 20 bp, Artificial Sequence
  Synthetic Oligonucleotide
caattcatgctcttgtgtgt

SEQ ID NO: 522 - DNA, 21 bp, Artificial Sequence
  Synthetic Oligonucleotide
caattgcgtgtaagttgcgtt

SEQ ID NO: 523 - DNA, 20 bp, Artificial Sequence
  Synthetic Oligonucleotide
caattgaggttcttactttt

SEQ ID NO: 524 - DNA, 20 bp, Artificial Sequence
  Synthetic Oligonucleotide
caattaccaatcttttggtt

SEQ ID NO: 525 - DNA, 21 bp, Artificial Sequence
  Synthetic Oligonucleotide
aaattgtccataagttggact

SEQ ID NO: 526 - DNA, 21 bp, Artificial Sequence
  Synthetic Oligonucleotide
caatttgtgttaagtacatgt

SEQ ID NO: 527 - DNA, 21 bp, Artificial Sequence
  Synthetic Oligonucleotide
caattgcctgtaagtcaggtt

SEQ ID NO: 528 - DNA, 20 bp, Artificial Sequence
  Synthetic Oligonucleotide
caatttgttgtcttcgatat

SEQ ID NO: 529 - DNA, 20 bp, Artificial Sequence
  Synthetic Oligonucleotide
caattctcgttcttgtgggt

SEQ ID NO: 530 - DNA, 20 bp, Artificial Sequence
  Synthetic Oligonucleotide
caattgcgcctcttggcgtt

SEQ ID NO: 531 - DNA, 21 bp, Artificial Sequence
  Synthetic Oligonucleotide
caattggtgttaagtgtactt

SEQ ID NO: 532 - DNA, 20 bp, Artificial Sequence
  Synthetic Oligonucleotide
caattacgtgtctttatgtt

SEQ ID NO: 533 - DNA, 20 bp, Artificial Sequence
  Synthetic Oligonucleotide
caattgccattcttgtggct

SEQ ID NO: 534 - DNA, 21 bp, Artificial Sequence
  Synthetic Oligonucleotide
caatttgtagtaagtctgtat

SEQ ID NO: 535 - DNA, 21 bp, Artificial Sequence
  Synthetic Oligonucleotide
caattgcgcgtaagttgcgct

SEQ ID NO: 536 - DNA, 20 bp, Artificial Sequence
  Synthetic Oligonucleotide
caatttgacgtcttcgtcgt

SEQ ID NO: 537 - DNA, 20 bp, Artificial Sequence
  Synthetic Oligonucleotide
caatttgacctcttggtcgt

SEQ ID NO: 538 - DNA, 20 bp, Artificial Sequence
  Synthetic Oligonucleotide
caattgcgtgtctttgcgtt

SEQ ID NO: 539 - DNA, 20 bp, Artificial Sequence
  Synthetic Oligonucleotide
gaattgtccgtcttcgggct

SEQ ID NO: 540 - DNA, 20 bp, Artificial Sequence
  Synthetic Oligonucleotide
caattggttgtcttcggcct

SEQ ID NO: 541 - DNA, 20 bp, Artificial Sequence
  Synthetic Oligonucleotide
caatttcgtgtcttcacgat

SEQ ID NO: 542 - DNA, 20 bp, Artificial Sequence
  Synthetic Oligonucleotide
caatttcgtgtcttcatggt

SEQ ID NO: 543 - DNA, 20 bp, Artificial Sequence
  Synthetic Oligonucleotide
caattcagtgtcttcgttgt

SEQ ID NO: 544 - DNA, 21 bp, Artificial Sequence
  Synthetic Oligonucleotide
caattgtagttaagtgttact

SEQ ID NO: 545 - DNA, 21 bp, Artificial Sequence
  Synthetic Oligonucleotide
gaatttgtgttaagtatgcgt

SEQ ID NO: 546 - DNA, 20 bp, Artificial Sequence
  Synthetic Oligonucleotide
caatttgggttcttgcccat

SEQ ID NO: 547 - DNA, 21 bp, Artificial Sequence
  Synthetic Oligonucleotide
caattgttgctaagtgcggtt

SEQ ID NO: 548 - DNA, 20 bp, Artificial Sequence
  Synthetic Oligonucleotide
caattgcgcgtcttcgtgct

SEQ ID NO: 549 - DNA, 21 bp, Artificial Sequence
  Synthetic Oligonucleotide
caatttgcactaagtgtgcat

SEQ ID NO: 550 - DNA, 21 bp, Artificial Sequence
  Synthetic Oligonucleotide
caatttatgttaagtatgtgt

SEQ ID NO: 551 - DNA, 20 bp, Artificial Sequence
  Synthetic Oligonucleotide
gaattgcgtttcttgacgct

SEQ ID NO: 552 - DNA, 21 bp, Artificial Sequence
  Synthetic Oligonucleotide
caattcggtctaagtggttgt

SEQ ID NO: 553 - DNA, 21 bp, Artificial Sequence
  Synthetic Oligonucleotide
caattcgcgttaagtgcgcgt

SEQ ID NO: 554 - DNA, 21 bp, Artificial Sequence
  Synthetic Oligonucleotide
caatttggcctaagtggttgt

SEQ ID NO: 555 - DNA, 20 bp, Artificial Sequence
  Synthetic Oligonucleotide
caattcgggttcttatttgt

SEQ ID NO: 556 - DNA, 21 bp, Artificial Sequence
  Synthetic Oligonucleotide
caattgcctctaagtggggtt

SEQ ID NO: 557 - DNA, 20 bp, Artificial Sequence
  Synthetic Oligonucleotide
gaatttacgttcttacgtat

SEQ ID NO: 558 - DNA, 20 bp, Artificial Sequence
  Synthetic Oligonucleotide
caatttgtgatcttttgtgt

SEQ ID NO: 559 - DNA, 20 bp, Artificial Sequence
  Synthetic Oligonucleotide
caattcgcgctcttgtgcgt

SEQ ID NO: 560 - DNA, 21 bp, Artificial Sequence
  Synthetic Oligonucleotide
caatttgtagtaagtctacat

SEQ ID NO: 561 - DNA, 20 bp, Artificial Sequence
  Synthetic Oligonucleotide
caattcgttgtcttcagtgt

SEQ ID NO: 562 - DNA, 21 bp, Artificial Sequence
  Synthetic Oligonucleotide
caatttgtcgtaagtcggcgt

SEQ ID NO: 563 - DNA, 20 bp, Artificial Sequence
  Synthetic Oligonucleotide
gaatttagcttcttggctgt

SEQ ID NO: 564 - DNA, 20 bp, Artificial Sequence
  Synthetic Oligonucleotide
caattgtacgtctttgtgct

SEQ ID NO: 565 - DNA, 21 bp, Artificial Sequence
  Synthetic Oligonucleotide
caatttcttgtaagttgggat

SEQ ID NO: 566 - DNA, 21 bp, Artificial Sequence
  Synthetic Oligonucleotide
caattcggtttaagtagccgt

SEQ ID NO: 567 - DNA, 21 bp, Artificial Sequence
  Synthetic Oligonucleotide
caattcgcagtaagtttgcgt

SEQ ID NO: 568 - DNA, 21 bp, Artificial Sequence
  Synthetic Oligonucleotide
caattttggttaagtgttaat

SEQ ID NO: 569 - DNA, 21 bp, Artificial Sequence
  Synthetic Oligonucleotide
gaatttcttctaagtgaagat

SEQ ID NO: 570 - DNA, 22 bp, Artificial Sequence
  Synthetic Oligonucleotide
aaatttctactagagtgtagat

SEQ ID NO: 571 - DNA, 22 bp, Artificial Sequence
  Synthetic Oligonucleotide
gaatttctacttgcttgtagat

SEQ ID NO: 572 - DNA, 22 bp, Artificial Sequence
  Synthetic Oligonucleotide
aaatttctactattcagtagat

SEQ ID NO: 573 - DNA, 21 bp, Artificial Sequence
  Synthetic Oligonucleotide
aaatttctacttgctgtagat

SEQ ID NO: 574 - DNA, 21 bp, Artificial Sequence
  Synthetic Oligonucleotide
caatttctactttgcgtagat

SEQ ID NO: 575 - DNA, 21 bp, Artificial Sequence
  Synthetic Oligonucleotide
caatttctactaagtgtagat

SEQ ID NO: 576 - DNA, 22 bp, Artificial Sequence
  Synthetic Oligonucleotide
aaatttctactccgccgtagat

SEQ ID NO: 577 - DNA, 22 bp, Artificial Sequence
  Synthetic Oligonucleotide
caatttctacttcaatgtagat

SEQ ID NO: 578 - DNA, 22 bp, Artificial Sequence
  Synthetic Oligonucleotide
caatttctactagattgtagat

SEQ ID NO: 579 - DNA, 21 bp, Artificial Sequence
  Synthetic Oligonucleotide
gaatttctacttagagtagat

SEQ ID NO: 580 - DNA, 22 bp, Artificial Sequence
  Synthetic Oligonucleotide
gaatttctcctatcgtggagat

SEQ ID NO: 581 - DNA, 21 bp, Artificial Sequence
  Synthetic Oligonucleotide
gaatttctactcggcgtagat

SEQ ID NO: 582 - DNA, 20 bp, Artificial Sequence
  Synthetic Oligonucleotide
gaatttctactttagtagat

SEQ ID NO: 583 - DNA, 21 bp, Artificial Sequence
  Synthetic Oligonucleotide
aaatttctactacaagtagat

SEQ ID NO: 584 - DNA, 20 bp, Artificial Sequence
  Synthetic Oligonucleotide
gaatttctacttaggtagat

SEQ ID NO: 585 - DNA, 21 bp, Artificial Sequence
  Synthetic Oligonucleotide
aaatttctactgcttgtagat

SEQ ID NO: 586 - DNA, 22 bp, Artificial Sequence
  Synthetic Oligonucleotide
gaatttctactagtgtgtagat

SEQ ID NO: 587 - DNA, 22 bp, Artificial Sequence
  Synthetic Oligonucleotide
aaatttctactgtggtgtagat

SEQ ID NO: 588 - DNA, 21 bp, Artificial Sequence
  Synthetic Oligonucleotide
aaattccttctaagtgaaggt

SEQ ID NO: 589 - DNA, 22 bp, Artificial Sequence
  Synthetic Oligonucleotide
caatttctactaccgagtagat

SEQ ID NO: 590 - DNA, 22 bp, Artificial Sequence
  Synthetic Oligonucleotide
gaatttctactgtcgggtagat

SEQ ID NO: 591 - DNA, 22 bp, Artificial Sequence
  Synthetic Oligonucleotide
gaatttctactgttgtgtagat

SEQ ID NO: 592 - DNA, 22 bp, Artificial Sequence
  Synthetic Oligonucleotide
gaatttctactatgatgtagat

SEQ ID NO: 593 - DNA, 22 bp, Artificial Sequence
  Synthetic Oligonucleotide
gaatttctacttcaacgtagat

SEQ ID NO: 594 - DNA, 22 bp, Artificial Sequence
  Synthetic Oligonucleotide
gaatttctactgcgatgtagat

SEQ ID NO: 595 - DNA, 21 bp, Artificial Sequence
  Synthetic Oligonucleotide
caattcctcgtaagtcgaggt

SEQ ID NO: 596 - DNA, 22 bp, Artificial Sequence
  Synthetic Oligonucleotide
gaatttctactatcatgtagat

SEQ ID NO: 597 - DNA, 22 bp, Artificial Sequence
  Synthetic Oligonucleotide
gaatttctactaacgtgtagat

SEQ ID NO: 598 - DNA, 21 bp, Artificial Sequence
  Synthetic Oligonucleotide
aaatttctactaggcgtagat

SEQ ID NO: 599 - DNA, 22 bp, Artificial Sequence
  Synthetic Oligonucleotide
gaatttctactataaggtagat

SEQ ID NO: 600 - DNA, 22 bp, Artificial Sequence
  Synthetic Oligonucleotide
aaatttctactacagcgtagat

SEQ ID NO: 601 - DNA, 21 bp, Artificial Sequence
  Synthetic Oligonucleotide
aaatttctcctagtcggagat

SEQ ID NO: 602 - DNA, 22 bp, Artificial Sequence
  Synthetic Oligonucleotide
caatttctactatggggtagat

SEQ ID NO: 603 - DNA, 22 bp, Artificial Sequence
  Synthetic Oligonucleotide
gaatttctactacagtgtagat

SEQ ID NO: 604 - DNA, 22 bp, Artificial Sequence
  Synthetic Oligonucleotide
gaatttctactggccagtagat

SEQ ID NO: 605 - DNA, 22 bp, Artificial Sequence
  Synthetic Oligonucleotide
gaatttctactatactgtagat

SEQ ID NO: 606 - DNA, 22 bp, Artificial Sequence
  Synthetic Oligonucleotide
caatttctcctagggcggagat

SEQ ID NO: 607 - DNA, 22 bp, Artificial Sequence
  Synthetic Oligonucleotide
gaatttctacttctccgtagat

SEQ ID NO: 608 - DNA, 21 bp, Artificial Sequence
  Synthetic Oligonucleotide
caatttctactaggcgtagat

SEQ ID NO: 609 - DNA, 22 bp, Artificial Sequence
  Synthetic Oligonucleotide
caatttctactgtttggtagat

SEQ ID NO: 610 - DNA, 21 bp, Artificial Sequence
  Synthetic Oligonucleotide
caatttctacttcacgtagat

SEQ ID NO: 611 - DNA, 22 bp, Artificial Sequence
  Synthetic Oligonucleotide
aaatttctactactgtgtagat

SEQ ID NO: 612 - DNA, 22 bp, Artificial Sequence
  Synthetic Oligonucleotide
caatttctactgtttagtagat

SEQ ID NO: 613 - DNA, 22 bp, Artificial Sequence
  Synthetic Oligonucleotide
aaatttctacttcgccgtagat

SEQ ID NO: 614 - DNA, 22 bp, Artificial Sequence
  Synthetic Oligonucleotide
aaatttctactgctgtgtagat

SEQ ID NO: 615 - DNA, 22 bp, Artificial Sequence
  Synthetic Oligonucleotide
caatttctacttctatgtagat

SEQ ID NO: 616 - DNA, 22 bp, Artificial Sequence
  Synthetic Oligonucleotide
caatttctactagggcgtagat

SEQ ID NO: 617 - DNA, 21 bp, Artificial Sequence
  Synthetic Oligonucleotide
gaatttctactaggcgtagat

SEQ ID NO: 618 - DNA, 21 bp, Artificial Sequence
  Synthetic Oligonucleotide
gaatttctacttggagtagat

SEQ ID NO: 619 - DNA, 22 bp, Artificial Sequence
  Synthetic Oligonucleotide
gaatttctactagcgagtagat

SEQ ID NO: 620 - DNA, 22 bp, Artificial Sequence
  Synthetic Oligonucleotide
aaatttctactaatgggtagat

SEQ ID NO: 621 - DNA, 22 bp, Artificial Sequence
  Synthetic Oligonucleotide
gaatttctactgaagggtagat

SEQ ID NO: 622 - DNA, 20 bp, Artificial Sequence
  Synthetic Oligonucleotide
caatttctactcgggtagat

SEQ ID NO: 623 - DNA, 20 bp, Artificial Sequence
  Synthetic Oligonucleotide
aaatttctactcctgtagat

SEQ ID NO: 624 - DNA, 22 bp, Artificial Sequence
  Synthetic Oligonucleotide
gaatttctactaatctgtagat

SEQ ID NO: 625 - DNA, 22 bp, Artificial Sequence
  Synthetic Oligonucleotide
gaatttctactggcgagtagat

SEQ ID NO: 626 - DNA, 21 bp, Artificial Sequence
  Synthetic Oligonucleotide
gaatttctccttcgtggagat

SEQ ID NO: 627 - DNA, 21 bp, Artificial Sequence
  Synthetic Oligonucleotide
gaatttctactggttgtagat

SEQ ID NO: 628 - DNA, 22 bp, Artificial Sequence
  Synthetic Oligonucleotide
gaatttctactcatcggtagat

SEQ ID NO: 629 - DNA, 22 bp, Artificial Sequence
  Synthetic Oligonucleotide
gaatttctactcgatcgtagat

SEQ ID NO: 630 - DNA, 22 bp, Artificial Sequence
  Synthetic Oligonucleotide
aaatttctactttcaggtagat

SEQ ID NO: 631 - DNA, 22 bp, Artificial Sequence
  Synthetic Oligonucleotide
caatttctactacggggtagat

SEQ ID NO: 632 - DNA, 21 bp, Artificial Sequence
  Synthetic Oligonucleotide
aaattcctgctaagtgcaggt

SEQ ID NO: 633 - DNA, 22 bp, Artificial Sequence
  Synthetic Oligonucleotide
gaatttctacttgatagtagat

SEQ ID NO: 634 - DNA, 22 bp, Artificial Sequence
  Synthetic Oligonucleotide
caatttctactggagcgtagat

SEQ ID NO: 635 - DNA, 22 bp, Artificial Sequence
  Synthetic Oligonucleotide
caatttctactctagggtagat

SEQ ID NO: 636 - DNA, 22 bp, Artificial Sequence
  Synthetic Oligonucleotide
gaatttctactccggtgtagat

SEQ ID NO: 637 - DNA, 21 bp, Artificial Sequence
  Synthetic Oligonucleotide
caatttctactatttgtagat

SEQ ID NO: 638 - DNA, 22 bp, Artificial Sequence
  Synthetic Oligonucleotide
aaatttctacttgcctgtagat

SEQ ID NO: 639 - DNA, 22 bp, Artificial Sequence
  Synthetic Oligonucleotide
caatttctcctaagatggagat

SEQ ID NO: 640 - DNA, 22 bp, Artificial Sequence
  Synthetic Oligonucleotide
gaatttctacttactggtagat

SEQ ID NO: 641 - DNA, 21 bp, Artificial Sequence
  Synthetic Oligonucleotide
gaatttctactacgcgtagat

SEQ ID NO: 642 - DNA, 22 bp, Artificial Sequence
  Synthetic Oligonucleotide
gaatttctcctatagtggagat

SEQ ID NO: 643 - DNA, 22 bp, Artificial Sequence
  Synthetic Oligonucleotide
caatttctacttttctgtagat

SEQ ID NO: 644 - DNA, 22 bp, Artificial Sequence
  Synthetic Oligonucleotide
caatttctcctacagtggagat

SEQ ID NO: 645 - DNA, 22 bp, Artificial Sequence
  Synthetic Oligonucleotide
caatttctactggtgcgtagat

SEQ ID NO: 646 - DNA, 22 bp, Artificial Sequence
  Synthetic Oligonucleotide
gaatttctactgtagagtagat

SEQ ID NO: 647 - DNA, 22 bp, Artificial Sequence
  Synthetic Oligonucleotide
gaatttctacttctgcgtagat

SEQ ID NO: 648 - DNA, 21 bp, Artificial Sequence
  Synthetic Oligonucleotide
caatttctactatgcgtagat

SEQ ID NO: 649 - DNA, 22 bp, Artificial Sequence
  Synthetic Oligonucleotide
aaatttctacttaactgtagat

SEQ ID NO: 650 - DNA, 21 bp, Artificial Sequence
  Synthetic Oligonucleotide
gaatttctactaagtgtagat

SEQ ID NO: 651 - DNA, 22 bp, Artificial Sequence
  Synthetic Oligonucleotide
gaatttctactggcccgtagat

SEQ ID NO: 652 - DNA, 22 bp, Artificial Sequence
  Synthetic Oligonucleotide
gaatttctcctatgttggagat

SEQ ID NO: 653 - DNA, 20 bp, Artificial Sequence
  Synthetic Oligonucleotide
gaattgactctcttgggttt

SEQ ID NO: 654 - DNA, 22 bp, Artificial Sequence
  Synthetic Oligonucleotide
gaatttctactcagtcgtagat

SEQ ID NO: 655 - DNA, 22 bp, Artificial Sequence
  Synthetic Oligonucleotide
caatttctactagcttgtagat

SEQ ID NO: 656 - DNA, 21 bp, Artificial Sequence
  Synthetic Oligonucleotide
caatttctactgacagtagat

SEQ ID NO: 657 - DNA, 21 bp, Artificial Sequence
  Synthetic Oligonucleotide
gaatttctactatctgtagat

SEQ ID NO: 658 - DNA, 22 bp, Artificial Sequence
  Synthetic Oligonucleotide
aaatttctactacgcggtagat

SEQ ID NO: 659 - DNA, 21 bp, Artificial Sequence
  Synthetic Oligonucleotide
caatttctactaggggtagat

SEQ ID NO: 660 - DNA, 22 bp, Artificial Sequence
  Synthetic Oligonucleotide
aaatttctactagtacgtagat

SEQ ID NO: 661 - DNA, 22 bp, Artificial Sequence
  Synthetic Oligonucleotide
aaatttctactggattgtagat

SEQ ID NO: 662 - DNA, 21 bp, Artificial Sequence
  Synthetic Oligonucleotide
caatttctactacgtgtagat

SEQ ID NO: 663 - DNA, 22 bp, Artificial Sequence
  Synthetic Oligonucleotide
caatttctactatagtgtagat

SEQ ID NO: 664 - DNA, 21 bp, Artificial Sequence
  Synthetic Oligonucleotide
caatttctactatgggtagat

SEQ ID NO: 665 - DNA, 21 bp, Artificial Sequence
  Synthetic Oligonucleotide
gaattatgtgtaagtcacgtt

SEQ ID NO: 666 - DNA, 20 bp, Artificial Sequence
  Synthetic Oligonucleotide
gaatttctactctcgtagat

SEQ ID NO: 667 - DNA, 22 bp, Artificial Sequence
  Synthetic Oligonucleotide
gaatttctacttctttgtagat

SEQ ID NO: 668 - DNA, 22 bp, Artificial Sequence
  Synthetic Oligonucleotide
caatttctactttagtgtagat

SEQ ID NO: 669 - DNA, 21 bp, Artificial Sequence
  Synthetic Oligonucleotide
gaatttctactagtagtagat

SEQ ID NO: 670 - DNA, 22 bp, Artificial Sequence
  Synthetic Oligonucleotide
aaatttctactgcactgtagat

SEQ ID NO: 671 - DNA, 22 bp, Artificial Sequence
  Synthetic Oligonucleotide
caatttctactatagcgtagat

SEQ ID NO: 672 - DNA, 22 bp, Artificial Sequence
  Synthetic Oligonucleotide
aaatttctactaggatgtagat

SEQ ID NO: 673 - DNA, 21 bp, Artificial Sequence
  Synthetic Oligonucleotide
caatttctactatgagtagat

SEQ ID NO: 674 - DNA, 20 bp, Artificial Sequence
  Synthetic Oligonucleotide
caatttctactgtggtagat

SEQ ID NO: 675 - DNA, 22 bp, Artificial Sequence
  Synthetic Oligonucleotide
aaatttctactatagggtagat

SEQ ID NO: 676 - DNA, 22 bp, Artificial Sequence
  Synthetic Oligonucleotide
gaatttctactgagtggtagat

SEQ ID NO: 677 - DNA, 20 bp, Artificial Sequence
  Synthetic Oligonucleotide
caatttctactctagtagat

SEQ ID NO: 678 - DNA, 22 bp, Artificial Sequence
  Synthetic Oligonucleotide
caatttctactaccaagtagat

SEQ ID NO: 679 - DNA, 21 bp, Artificial Sequence
  Synthetic Oligonucleotide
aaatttctactggcagtagat

SEQ ID NO: 680 - DNA, 21 bp, Artificial Sequence
  Synthetic Oligonucleotide
gaatttctcctatccggagat

SEQ ID NO: 681 - DNA, 21 bp, Artificial Sequence
  Synthetic Oligonucleotide
caatttctactgaaagtagat

SEQ ID NO: 682 - DNA, 22 bp, Artificial Sequence
  Synthetic Oligonucleotide
gaatttctcctatcgcggagat

SEQ ID NO: 683 - DNA, 22 bp, Artificial Sequence
  Synthetic Oligonucleotide
caatttctactcctaagtagat

SEQ ID NO: 684 - DNA, 22 bp, Artificial Sequence
  Synthetic Oligonucleotide
gaatttctactactgagtagat

SEQ ID NO: 685 - DNA, 22 bp, Artificial Sequence
  Synthetic Oligonucleotide
gaatttctactagtctgtagat

SEQ ID NO: 686 - DNA, 22 bp, Artificial Sequence
  Synthetic Oligonucleotide
caatttctacttctctgtagat

SEQ ID NO: 687 - DNA, 21 bp, Artificial Sequence
  Synthetic Oligonucleotide
aaatttctaccacttgtagat

SEQ ID NO: 688 - DNA, 22 bp, Artificial Sequence
  Synthetic Oligonucleotide
caatttctacttgttcgtagat

SEQ ID NO: 689 - DNA, 22 bp, Artificial Sequence
  Synthetic Oligonucleotide
gaatttctactcacacgtagat

SEQ ID NO: 690 - DNA, 22 bp, Artificial Sequence
  Synthetic Oligonucleotide
caatttctcctatagaggagat

SEQ ID NO: 691 - DNA, 22 bp, Artificial Sequence
  Synthetic Oligonucleotide
gaatttctactaccccgtagat

SEQ ID NO: 692 - DNA, 22 bp, Artificial Sequence
  Synthetic Oligonucleotide
gaatttctactgccgagtagat

SEQ ID NO: 693 - DNA, 22 bp, Artificial Sequence
  Synthetic Oligonucleotide
gaatttctactcactagtagat

SEQ ID NO: 694 - DNA, 22 bp, Artificial Sequence
  Synthetic Oligonucleotide
gaatttctactcaaacgtagat

SEQ ID NO: 695 - DNA, 22 bp, Artificial Sequence
  Synthetic Oligonucleotide
gaatttctactctcttgtagat

SEQ ID NO: 696 - DNA, 22 bp, Artificial Sequence
  Synthetic Oligonucleotide
aaatttctactcttcggtagat

SEQ ID NO: 697 - DNA, 22 bp, Artificial Sequence
  Synthetic Oligonucleotide
gaatttctactcggtagtagat

SEQ ID NO: 698 - DNA, 22 bp, Artificial Sequence
  Synthetic Oligonucleotide
gaatttctactccggcgtagat

SEQ ID NO: 699 - DNA, 21 bp, Artificial Sequence
  Synthetic Oligonucleotide
caatttctcctagatggagat

SEQ ID NO: 700 - DNA, 22 bp, Artificial Sequence
  Synthetic Oligonucleotide
gaatttctactgccgtgtagat

SEQ ID NO: 701 - DNA, 20 bp, Artificial Sequence
  Synthetic Oligonucleotide
aaatttctcctatgggagat

SEQ ID NO: 702 - DNA, 22 bp, Artificial Sequence
  Synthetic Oligonucleotide
gaatttctactataccgtagat

SEQ ID NO: 703 - DNA, 22 bp, Artificial Sequence
  Synthetic Oligonucleotide
aaatttctcctaacttggagat

SEQ ID NO: 704 - DNA, 21 bp, Artificial Sequence
  Synthetic Oligonucleotide
caatttctactatgtgtagat

SEQ ID NO: 705 - DNA, 21 bp, Artificial Sequence
  Synthetic Oligonucleotide
gaatttctactaggtgtagat

SEQ ID NO: 706 - DNA, 22 bp, Artificial Sequence
  Synthetic Oligonucleotide
gaatttctactgacaagtagat

SEQ ID NO: 707 - DNA, 22 bp, Artificial Sequence
  Synthetic Oligonucleotide
gaatttctacaccaaagtagat

SEQ ID NO: 708 - DNA, 22 bp, Artificial Sequence
  Synthetic Oligonucleotide
caatttctactaatttgtagat

SEQ ID NO: 709 - DNA, 22 bp, Artificial Sequence
  Synthetic Oligonucleotide
caatttctactaaaccgtagat

SEQ ID NO: 710 - DNA, 21 bp, Artificial Sequence
  Synthetic Oligonucleotide
caatttctacttcaggtagat

SEQ ID NO: 711 - DNA, 22 bp, Artificial Sequence
  Synthetic Oligonucleotide
gaatttctcctcaaacggagat

SEQ ID NO: 712 - DNA, 22 bp, Artificial Sequence
  Synthetic Oligonucleotide
gaatttctactgttgagtagat

SEQ ID NO: 713 - DNA, 21 bp, Artificial Sequence
  Synthetic Oligonucleotide
caatttctcctatttggagat

SEQ ID NO: 714 - DNA, 22 bp, Artificial Sequence
  Synthetic Oligonucleotide
aaatttctactccgtggtagat

SEQ ID NO: 715 - DNA, 22 bp, Artificial Sequence
  Synthetic Oligonucleotide
aaatttctacttcagtgtagat

SEQ ID NO: 716 - DNA, 22 bp, Artificial Sequence
  Synthetic Oligonucleotide
aaatttctcctaggttggagat

SEQ ID NO: 717 - DNA, 22 bp, Artificial Sequence
  Synthetic Oligonucleotide
gaatttctaccaacttgtagat

SEQ ID NO: 718 - DNA, 21 bp, Artificial Sequence
  Synthetic Oligonucleotide
caatttctactacgcgtagat

SEQ ID NO: 719 - DNA, 22 bp, Artificial Sequence
  Synthetic Oligonucleotide
gaatttctacttgagtgtagat

SEQ ID NO: 720 - DNA, 22 bp, Artificial Sequence
  Synthetic Oligonucleotide
gaatttctactgattggtagat

SEQ ID NO: 721 - DNA, 21 bp, Artificial Sequence
  Synthetic Oligonucleotide
aaatttctactgcgagtagat

SEQ ID NO: 722 - DNA, 20 bp, Artificial Sequence
  Synthetic Oligonucleotide
aaatttgtcttcttaggtgt

SEQ ID NO: 723 - DNA, 22 bp, Artificial Sequence
  Synthetic Oligonucleotide
caatttctacttgagagtagat

SEQ ID NO: 724 - DNA, 22 bp, Artificial Sequence
  Synthetic Oligonucleotide
caatttctactatacggtagat

SEQ ID NO: 725 - DNA, 22 bp, Artificial Sequence
  Synthetic Oligonucleotide
gaatttctactgagatgtagat

SEQ ID NO: 726 - DNA, 21 bp, Artificial Sequence
  Synthetic Oligonucleotide
caatttctacttgtggtagat

SEQ ID NO: 727 - DNA, 22 bp, Artificial Sequence
  Synthetic Oligonucleotide
caatttctactggcacgtagat

SEQ ID NO: 728 - DNA, 22 bp, Artificial Sequence
  Synthetic Oligonucleotide
aaatttctcctaaagcggagat

SEQ ID NO: 729 - DNA, 21 bp, Artificial Sequence
  Synthetic Oligonucleotide
gaatttctactcgctgtagat

SEQ ID NO: 730 - DNA, 22 bp, Artificial Sequence
  Synthetic Oligonucleotide
caatttctactctttcgtagat

SEQ ID NO: 731 - DNA, 21 bp, Artificial Sequence
  Synthetic Oligonucleotide
gaatttctactacgagtagat

SEQ ID NO: 732 - DNA, 22 bp, Artificial Sequence
  Synthetic Oligonucleotide
aaatttctactgcgccgtagat

SEQ ID NO: 733 - DNA, 21 bp, Artificial Sequence
  Synthetic Oligonucleotide
caatttctaccaaatgtagat

SEQ ID NO: 734 - DNA, 21 bp, Artificial Sequence
  Synthetic Oligonucleotide
gaatttctactagtggtagat

SEQ ID NO: 735 - DNA, 22 bp, Artificial Sequence
  Synthetic Oligonucleotide
gaatttctactttaacgtagat

SEQ ID NO: 736 - DNA, 22 bp, Artificial Sequence
  Synthetic Oligonucleotide
gaatttctacttcgcagtagat

SEQ ID NO: 737 - DNA, 22 bp, Artificial Sequence
  Synthetic Oligonucleotide
caatttctactccgtcgtagat

SEQ ID NO: 738 - DNA, 22 bp, Artificial Sequence
  Synthetic Oligonucleotide
gaatttctactccgttgtagat

SEQ ID NO: 739 - DNA, 21 bp, Artificial Sequence
  Synthetic Oligonucleotide
gaatttctcctgtgcggagat

SEQ ID NO: 740 - DNA, 22 bp, Artificial Sequence
  Synthetic Oligonucleotide
caatttctactattgagtagat

SEQ ID NO: 741 - DNA, 22 bp, Artificial Sequence
  Synthetic Oligonucleotide
gaatttctactcttacgtagat

SEQ ID NO: 742 - DNA, 22 bp, Artificial Sequence
  Synthetic Oligonucleotide
caatttctactgagacgtagat

SEQ ID NO: 743 - DNA, 22 bp, Artificial Sequence
  Synthetic Oligonucleotide
caatttctactaaggagtagat

SEQ ID NO: 744 - DNA, 21 bp, Artificial Sequence
  Synthetic Oligonucleotide
aaatttctactaagcgtagat

SEQ ID NO: 745 - DNA, 21 bp, Artificial Sequence
  Synthetic Oligonucleotide
gaatttctactctgggtagat

SEQ ID NO: 746 - DNA, 22 bp, Artificial Sequence
  Synthetic Oligonucleotide
caatttctactgtggtgtagat

SEQ ID NO: 747 - DNA, 22 bp, Artificial Sequence
  Synthetic Oligonucleotide
aaatttctactcttcagtagat

SEQ ID NO: 748 - DNA, 22 bp, Artificial Sequence
  Synthetic Oligonucleotide
caatttctactgttgggtagat

SEQ ID NO: 749 - DNA, 21 bp, Artificial Sequence
  Synthetic Oligonucleotide
aaatttctcctaccaggagat

SEQ ID NO: 750 - DNA, 21 bp, Artificial Sequence
  Synthetic Oligonucleotide
caatttctcctaaggggagat

SEQ ID NO: 751 - DNA, 22 bp, Artificial Sequence
  Synthetic Oligonucleotide
gaatttctacttcatagtagat

SEQ ID NO: 752 - DNA, 22 bp, Artificial Sequence
  Synthetic Oligonucleotide
caatttctactcgaccgtagat

SEQ ID NO: 753 - DNA, 21 bp, Artificial Sequence
  Synthetic Oligonucleotide
caatttctacttatggtagat

SEQ ID NO: 754 - DNA, 22 bp, Artificial Sequence
  Synthetic Oligonucleotide
aaatttctactgaatcgtagat

SEQ ID NO: 755 - DNA, 21 bp, Artificial Sequence
  Synthetic Oligonucleotide
aaatttctactaagggtagat

SEQ ID NO: 756 - DNA, 21 bp, Artificial Sequence
  Synthetic Oligonucleotide
gaatttctacttgtagtagat

SEQ ID NO: 757 - DNA, 22 bp, Artificial Sequence
  Synthetic Oligonucleotide
caatttctacttccgtgtagat

SEQ ID NO: 758 - DNA, 21 bp, Artificial Sequence
  Synthetic Oligonucleotide
caatttctactcaccgtagat

SEQ ID NO: 759 - DNA, 20 bp, Artificial Sequence
  Synthetic Oligonucleotide
caatttacaatcttttgtgt

SEQ ID NO: 760 - DNA, 22 bp, Artificial Sequence
  Synthetic Oligonucleotide
caatttctactcgatagtagat

SEQ ID NO: 761 - DNA, 21 bp, Artificial Sequence
  Synthetic Oligonucleotide
caatttctactaagagtagat

SEQ ID NO: 762 - DNA, 20 bp, Artificial Sequence
  Synthetic Oligonucleotide
caatttctacttttgtagat

SEQ ID NO: 763 - DNA, 20 bp, Artificial Sequence
  Synthetic Oligonucleotide
caatttctactatggtagat

SEQ ID NO: 764 - DNA, 22 bp, Artificial Sequence
  Synthetic Oligonucleotide
aaatttctactcccacgtagat

SEQ ID NO: 765 - DNA, 22 bp, Artificial Sequence
  Synthetic Oligonucleotide
caatttctactcaggcgtagat

SEQ ID NO: 766 - DNA, 22 bp, Artificial Sequence
  Synthetic Oligonucleotide
gaatttctcctagtgtggagat

SEQ ID NO: 767 - DNA, 20 bp, Artificial Sequence
  Synthetic Oligonucleotide
caattctccttcttgggggt

SEQ ID NO: 768 - DNA, 22 bp, Artificial Sequence
  Synthetic Oligonucleotide
gaatttctactggagcgtagat

SEQ ID NO: 769 - DNA, 22 bp, Artificial Sequence
  Synthetic Oligonucleotide
gaatttctcctaacgcggagat

SEQ ID NO: 770 - DNA, 22 bp, Artificial Sequence
  Synthetic Oligonucleotide
caatttctactagatcgtagat

SEQ ID NO: 771 - DNA, 21 bp, Artificial Sequence
  Synthetic Oligonucleotide
aaatttctactctgggtagat

SEQ ID NO: 772 - DNA, 21 bp, Artificial Sequence
  Synthetic Oligonucleotide
caatttctactacgggtagat

SEQ ID NO: 773 - DNA, 22 bp, Artificial Sequence
  Synthetic Oligonucleotide
gaatttctacttgtaagtagat

SEQ ID NO: 774 - DNA, 22 bp, Artificial Sequence
  Synthetic Oligonucleotide
caatttctacttgagggtagat

SEQ ID NO: 775 - DNA, 21 bp, Artificial Sequence
  Synthetic Oligonucleotide
gaatttctactaagcgtagat

SEQ ID NO: 776 - DNA, 22 bp, Artificial Sequence
  Synthetic Oligonucleotide
caatttctactagagggtagat

SEQ ID NO: 777 - DNA, 22 bp, Artificial Sequence
  Synthetic Oligonucleotide
gaatttctactcctgcgtagat

SEQ ID NO: 778 - DNA, 22 bp, Artificial Sequence
  Synthetic Oligonucleotide
caatttctactaggtggtagat

SEQ ID NO: 779 - DNA, 21 bp, Artificial Sequence
  Synthetic Oligonucleotide
caatttctcctacatggagat

SEQ ID NO: 780 - DNA, 22 bp, Artificial Sequence
  Synthetic Oligonucleotide
caatttctacttcagggtagat

SEQ ID NO: 781 - DNA, 21 bp, Artificial Sequence
  Synthetic Oligonucleotide
caatttctactcggtgtagat

SEQ ID NO: 782 - DNA, 22 bp, Artificial Sequence
  Synthetic Oligonucleotide
gaatttctactaagaggtagat

SEQ ID NO: 783 - DNA, 22 bp, Artificial Sequence
  Synthetic Oligonucleotide
caatttctactccggcgtagat

SEQ ID NO: 784 - DNA, 22 bp, Artificial Sequence
  Synthetic Oligonucleotide
caatttctactctatcgtagat

SEQ ID NO: 785 - DNA, 21 bp, Artificial Sequence
  Synthetic Oligonucleotide
caatttctactgccagtagat

SEQ ID NO: 786 - DNA, 22 bp, Artificial Sequence
  Synthetic Oligonucleotide
caatttctactagtgtgtagat

SEQ ID NO: 787 - DNA, 21 bp, Artificial Sequence
  Synthetic Oligonucleotide
caatttctacttctcgtagat

SEQ ID NO: 788 - DNA, 21 bp, Artificial Sequence
  Synthetic Oligonucleotide
caatttctcctctgaggagat

SEQ ID NO: 789 - DNA, 22 bp, Artificial Sequence
  Synthetic Oligonucleotide
caatttctactaatgtgtagat

SEQ ID NO: 790 - DNA, 22 bp, Artificial Sequence
  Synthetic Oligonucleotide
gaatttctactcgtgggtagat

SEQ ID NO: 791 - DNA, 22 bp, Artificial Sequence
  Synthetic Oligonucleotide
caatttctactgagatgtagat

SEQ ID NO: 792 - DNA, 22 bp, Artificial Sequence
  Synthetic Oligonucleotide
gaatttctactaccgtgtagat

SEQ ID NO: 793 - DNA, 21 bp, Artificial Sequence
  Synthetic Oligonucleotide
caatttctactcatggtagat

SEQ ID NO: 794 - DNA, 21 bp, Artificial Sequence
  Synthetic Oligonucleotide
caatttctactaaaggtagat

SEQ ID NO: 795 - DNA, 22 bp, Artificial Sequence
  Synthetic Oligonucleotide
gaatttctactctcatgtagat

SEQ ID NO: 796 - DNA, 21 bp, Artificial Sequence
  Synthetic Oligonucleotide
caatttctactatccgtagat

SEQ ID NO: 797 - DNA, 22 bp, Artificial Sequence
  Synthetic Oligonucleotide
caatttctccttatgtggagat

SEQ ID NO: 798 - DNA, 21 bp, Artificial Sequence
  Synthetic Oligonucleotide
caatttctactgagcgtagat

SEQ ID NO: 799 - DNA, 21 bp, Artificial Sequence
  Synthetic Oligonucleotide
caatttctactgttggtagat

SEQ ID NO: 800 - DNA, 21 bp, Artificial Sequence
  Synthetic Oligonucleotide
caatttctactaggtgtagat

SEQ ID NO: 801 - DNA, 22 bp, Artificial Sequence
  Synthetic Oligonucleotide
caatttctactagcaggtagat

SEQ ID NO: 802 - DNA, 21 bp, Artificial Sequence
  Synthetic Oligonucleotide
gaattagcgataagttcgctt

SEQ ID NO: 803 - DNA, 22 bp, Artificial Sequence
  Synthetic Oligonucleotide
aaatttctactcagcagtagat

SEQ ID NO: 804 - DNA, 22 bp, Artificial Sequence
  Synthetic Oligonucleotide
caatttctactatccggtagat

SEQ ID NO: 805 - DNA, 20 bp, Artificial Sequence
  Synthetic Oligonucleotide
gaatttctactattgtagat

SEQ ID NO: 806 - DNA, 22 bp, Artificial Sequence
  Synthetic Oligonucleotide
caatttctactgtggcgtagat

SEQ ID NO: 807 - DNA, 22 bp, Artificial Sequence
  Synthetic Oligonucleotide
gaatttctactatcgagtagat

SEQ ID NO: 808 - DNA, 22 bp, Artificial Sequence
  Synthetic Oligonucleotide
caatttctactctctagtagat

SEQ ID NO: 809 - DNA, 22 bp, Artificial Sequence
  Synthetic Oligonucleotide
caatttctacttaggtgtagat

SEQ ID NO: 810 - DNA, 21 bp, Artificial Sequence
  Synthetic Oligonucleotide
caattcctcctaagtggaggt

SEQ ID NO: 811 - DNA, 21 bp, Artificial Sequence
  Synthetic Oligonucleotide
caatttctactacctgtagat

SEQ ID NO: 812 - DNA, 22 bp, Artificial Sequence
  Synthetic Oligonucleotide
caatttctactttagcgtagat

SEQ ID NO: 813 - DNA, 21 bp, Artificial Sequence
  Synthetic Oligonucleotide
aaatttctacccgaggtagat

SEQ ID NO: 814 - DNA, 22 bp, Artificial Sequence
  Synthetic Oligonucleotide
gaatttctactgacccgtagat

SEQ ID NO: 815 - DNA, 21 bp, Artificial Sequence
  Synthetic Oligonucleotide
gaatttctactacaggtagat

SEQ ID NO: 816 - DNA, 21 bp, Artificial Sequence
  Synthetic Oligonucleotide
gaatttctacttagtgtagat

SEQ ID NO: 817 - DNA, 22 bp, Artificial Sequence
  Synthetic Oligonucleotide
gaatttctactcgtacgtagat

SEQ ID NO: 818 - DNA, 21 bp, Artificial Sequence
  Synthetic Oligonucleotide
caatttctacttcgggtagat

SEQ ID NO: 819 - DNA, 21 bp, Artificial Sequence
  Synthetic Oligonucleotide
aaatttctactacgcgtagat

SEQ ID NO: 820 - DNA, 21 bp, Artificial Sequence
  Synthetic Oligonucleotide
caatttctaccactagtagat

SEQ ID NO: 821 - DNA, 21 bp, Artificial Sequence
  Synthetic Oligonucleotide
aaatttctcctacgtggagat

SEQ ID NO: 822 - DNA, 22 bp, Artificial Sequence
  Synthetic Oligonucleotide
gaatttctactgttttgtagat

SEQ ID NO: 823 - DNA, 22 bp, Artificial Sequence
  Synthetic Oligonucleotide
caatttctacttcgtggtagat

SEQ ID NO: 824 - DNA, 22 bp, Artificial Sequence
  Synthetic Oligonucleotide
gaatttctactgcgtggtagat

SEQ ID NO: 825 - DNA, 22 bp, Artificial Sequence
  Synthetic Oligonucleotide
gaatttctacttcaaggtagat

SEQ ID NO: 826 - DNA, 22 bp, Artificial Sequence
  Synthetic Oligonucleotide
aaatttctacttgtcagtagat

SEQ ID NO: 827 - DNA, 22 bp, Artificial Sequence
  Synthetic Oligonucleotide
gaatttctactacaacgtagat

SEQ ID NO: 828 - DNA, 22 bp, Artificial Sequence
  Synthetic Oligonucleotide
gaatttctacttgctcgtagat

SEQ ID NO: 829 - DNA, 22 bp, Artificial Sequence
  Synthetic Oligonucleotide
gaatttctactcttcagtagat

SEQ ID NO: 830 - DNA, 21 bp, Artificial Sequence
  Synthetic Oligonucleotide
aaattttgactaagtgtcgat

SEQ ID NO: 831 - DNA, 21 bp, Artificial Sequence
  Synthetic Oligonucleotide
gaatttgcactaagtgtgtgt

SEQ ID NO: 832 - DNA, 22 bp, Artificial Sequence
  Synthetic Oligonucleotide
caatttctcctattccggagat

SEQ ID NO: 833 - DNA, 21 bp, Artificial Sequence
  Synthetic Oligonucleotide
caatttctactatctgtagat

SEQ ID NO: 834 - DNA, 21 bp, Artificial Sequence
  Synthetic Oligonucleotide
aaatttctactacgggtagat

SEQ ID NO: 835 - DNA, 22 bp, Artificial Sequence
  Synthetic Oligonucleotide
caatttctactaggcagtagat

SEQ ID NO: 836 - DNA, 22 bp, Artificial Sequence
  Synthetic Oligonucleotide
caatttctactttcttgtagat

SEQ ID NO: 837 - DNA, 22 bp, Artificial Sequence
  Synthetic Oligonucleotide
caatttctactacgaagtagat

SEQ ID NO: 838 - DNA, 21 bp, Artificial Sequence
  Synthetic Oligonucleotide
gaatttctactaattgtagat

SEQ ID NO: 839 - DNA, 22 bp, Artificial Sequence
  Synthetic Oligonucleotide
gaatttctactcgccagtagat

SEQ ID NO: 840 - DNA, 22 bp, Artificial Sequence
  Synthetic Oligonucleotide
caatttctactttcccgtagat

SEQ ID NO: 841 - DNA, 22 bp, Artificial Sequence
  Synthetic Oligonucleotide
gaatttctccgtttcaggagat

SEQ ID NO: 842 - DNA, 21 bp, Artificial Sequence
  Synthetic Oligonucleotide
aaatttctactccgcgtagat

SEQ ID NO: 843 - DNA, 22 bp, Artificial Sequence
  Synthetic Oligonucleotide
caatttctactgaagtgtagat

SEQ ID NO: 844 - DNA, 22 bp, Artificial Sequence
  Synthetic Oligonucleotide
caatttctactaacacgtagat

SEQ ID NO: 845 - DNA, 22 bp, Artificial Sequence
  Synthetic Oligonucleotide
gaatttctcctaccttggagat

SEQ ID NO: 846 - DNA, 20 bp, Artificial Sequence
  Synthetic Oligonucleotide
gaatttctacttgtgtagat

SEQ ID NO: 847 - DNA, 22 bp, Artificial Sequence
  Synthetic Oligonucleotide
gaatttctacttctaagtagat

SEQ ID NO: 848 - DNA, 20 bp, Artificial Sequence
  Synthetic Oligonucleotide
aaatttctcctgttggagat

SEQ ID NO: 849 - DNA, 22 bp, Artificial Sequence
  Synthetic Oligonucleotide
caatttctcctatttcggagat

SEQ ID NO: 850 - DNA, 21 bp, Artificial Sequence
  Synthetic Oligonucleotide
caatttctactacaggtagat

SEQ ID NO: 851 - DNA, 22 bp, Artificial Sequence
  Synthetic Oligonucleotide
caatttctactagcgggtagat

SEQ ID NO: 852 - DNA, 21 bp, Artificial Sequence
  Synthetic Oligonucleotide
caatttctcctagtaggagat

SEQ ID NO: 853 - DNA, 22 bp, Artificial Sequence
  Synthetic Oligonucleotide
caatttctactcccgggtagat

SEQ ID NO: 854 - DNA, 22 bp, Artificial Sequence
  Synthetic Oligonucleotide
gaatttctactgcagtgtagat

SEQ ID NO: 855 - DNA, 21 bp, Artificial Sequence
  Synthetic Oligonucleotide
aaatttctcctatgtggagat

SEQ ID NO: 856 - DNA, 22 bp, Artificial Sequence
  Synthetic Oligonucleotide
gaatttctactggagtgtagat

SEQ ID NO: 857 - DNA, 22 bp, Artificial Sequence
  Synthetic Oligonucleotide
gaatttctactattttgtagat

SEQ ID NO: 858 - DNA, 22 bp, Artificial Sequence
  Synthetic Oligonucleotide
gaatttctactcctctgtagat

SEQ ID NO: 859 - DNA, 22 bp, Artificial Sequence
  Synthetic Oligonucleotide
caatttctactatggtgtagat

SEQ ID NO: 860 - DNA, 22 bp, Artificial Sequence
  Synthetic Oligonucleotide
aaatttctacttatgcgtagat

SEQ ID NO: 861 - DNA, 20 bp, Artificial Sequence
  Synthetic Oligonucleotide
caatttctcctacaggagat

SEQ ID NO: 862 - DNA, 20 bp, Artificial Sequence
  Synthetic Oligonucleotide
aaatttctacttgagtagat

SEQ ID NO: 863 - DNA, 21 bp, Artificial Sequence
  Synthetic Oligonucleotide
caatttctactgcaggtagat

SEQ ID NO: 864 - DNA, 21 bp, Artificial Sequence
  Synthetic Oligonucleotide
caatttctactgggggtagat

SEQ ID NO: 865 - DNA, 22 bp, Artificial Sequence
  Synthetic Oligonucleotide
gaatttctactgtcaagtagat

SEQ ID NO: 866 - DNA, 21 bp, Artificial Sequence
  Synthetic Oligonucleotide
caatttctactacgagtagat

SEQ ID NO: 867 - DNA, 22 bp, Artificial Sequence
  Synthetic Oligonucleotide
gaatttctcctggtgtggagat

SEQ ID NO: 868 - DNA, 21 bp, Artificial Sequence
  Synthetic Oligonucleotide
caatttgtgataagttcgcgt

SEQ ID NO: 869 - DNA, 22 bp, Artificial Sequence
  Synthetic Oligonucleotide
aaatttctactttcccgtagat

SEQ ID NO: 870 - DNA, 22 bp, Artificial Sequence
  Synthetic Oligonucleotide
caatttctactaagtagtagat

SEQ ID NO: 871 - DNA, 21 bp, Artificial Sequence
  Synthetic Oligonucleotide
aaatttctactacaggtagat

SEQ ID NO: 872 - DNA, 22 bp, Artificial Sequence
  Synthetic Oligonucleotide
caatttctactgaactgtagat

SEQ ID NO: 873 - DNA, 21 bp, Artificial Sequence
  Synthetic Oligonucleotide
caatttctactgactgtagat

SEQ ID NO: 874 - DNA, 22 bp, Artificial Sequence
  Synthetic Oligonucleotide
gaatttctactaatcagtagat

SEQ ID NO: 875 - DNA, 22 bp, Artificial Sequence
  Synthetic Oligonucleotide
caatttctactccactgtagat

SEQ ID NO: 876 - DNA, 20 bp, Artificial Sequence
  Synthetic Oligonucleotide
gaattaaggttcttgtcttt

SEQ ID NO: 877 - DNA, 22 bp, Artificial Sequence
  Synthetic Oligonucleotide
gaatttctactccccggtagat

SEQ ID NO: 878 - DNA, 22 bp, Artificial Sequence
  Synthetic Oligonucleotide
gaatttctactggaacgtagat

SEQ ID NO: 879 - DNA, 22 bp, Artificial Sequence
  Synthetic Oligonucleotide
caatttctactgatgcgtagat

SEQ ID NO: 880 - DNA, 21 bp, Artificial Sequence
  Synthetic Oligonucleotide
aaatttctaccagtcgtagat

SEQ ID NO: 881 - DNA, 21 bp, Artificial Sequence
  Synthetic Oligonucleotide
gaatttctactcctcgtagat

SEQ ID NO: 882 - DNA, 22 bp, Artificial Sequence
  Synthetic Oligonucleotide
caatttctactgagttgtagat

SEQ ID NO: 883 - DNA, 22 bp, Artificial Sequence
  Synthetic Oligonucleotide
caatttctactaggctgtagat

SEQ ID NO: 884 - DNA, 22 bp, Artificial Sequence
  Synthetic Oligonucleotide
gaatttctacttcacggtagat

SEQ ID NO: 885 - DNA, 22 bp, Artificial Sequence
  Synthetic Oligonucleotide
aaatttctactataaggtagat

SEQ ID NO: 886 - DNA, 21 bp, Artificial Sequence
  Synthetic Oligonucleotide
caatttctactaggagtagat

SEQ ID NO: 887 - DNA, 21 bp, Artificial Sequence
  Synthetic Oligonucleotide
aaattgtcggtaagtccggct

SEQ ID NO: 888 - DNA, 22 bp, Artificial Sequence
  Synthetic Oligonucleotide
caatttctactccttagtagat

SEQ ID NO: 889 - DNA, 21 bp, Artificial Sequence
  Synthetic Oligonucleotide
caatttctactccaggtagat

SEQ ID NO: 890 - DNA, 21 bp, Artificial Sequence
  Synthetic Oligonucleotide
caatttctactgggtgtagat

SEQ ID NO: 891 - DNA, 20 bp, Artificial Sequence
  Synthetic Oligonucleotide
gaatttctactgaagtagat

SEQ ID NO: 892 - DNA, 22 bp, Artificial Sequence
  Synthetic Oligonucleotide
gaatttctactcgcacgtagat

SEQ ID NO: 893 - DNA, 22 bp, Artificial Sequence
  Synthetic Oligonucleotide
aaatttctactgcgtagtagat

SEQ ID NO: 894 - DNA, 22 bp, Artificial Sequence
  Synthetic Oligonucleotide
caatttctactcaggtgtagat

SEQ ID NO: 895 - DNA, 21 bp, Artificial Sequence
  Synthetic Oligonucleotide
caatttctcctacgtggagat

SEQ ID NO: 896 - DNA, 22 bp, Artificial Sequence
  Synthetic Oligonucleotide
caatttctactatactgtagat

SEQ ID NO: 897 - DNA, 22 bp, Artificial Sequence
  Synthetic Oligonucleotide
gaatttctactcaggcgtagat

SEQ ID NO: 898 - DNA, 20 bp, Artificial Sequence
  Synthetic Oligonucleotide
aaatttctactgccgtagat

SEQ ID NO: 899 - DNA, 22 bp, Artificial Sequence
  Synthetic Oligonucleotide
aaatttctactccgaagtagat

SEQ ID NO: 900 - DNA, 22 bp, Artificial Sequence
  Synthetic Oligonucleotide
caatttctcctatcgcggagat

SEQ ID NO: 901 - DNA, 22 bp, Artificial Sequence
  Synthetic Oligonucleotide
gaatttctactgctgggtagat

SEQ ID NO: 902 - DNA, 21 bp, Artificial Sequence
  Synthetic Oligonucleotide
caatttctacttggcgtagat

SEQ ID NO: 903 - DNA, 22 bp, Artificial Sequence
  Synthetic Oligonucleotide
gaatttctactcctaggtagat

SEQ ID NO: 904 - DNA, 21 bp, Artificial Sequence
  Synthetic Oligonucleotide
aaatttcgactaagtgttgat

SEQ ID NO: 905 - DNA, 22 bp, Artificial Sequence
  Synthetic Oligonucleotide
caatttctactcccttgtagat

SEQ ID NO: 906 - DNA, 22 bp, Artificial Sequence
  Synthetic Oligonucleotide
caatttctactgattagtagat

SEQ ID NO: 907 - DNA, 22 bp, Artificial Sequence
  Synthetic Oligonucleotide
caatttctactctgtagtagat

SEQ ID NO: 908 - DNA, 22 bp, Artificial Sequence
  Synthetic Oligonucleotide
caatttctactcttatgtagat

SEQ ID NO: 909 - DNA, 22 bp, Artificial Sequence
  Synthetic Oligonucleotide
gaatttctactgcagagtagat

SEQ ID NO: 910 - DNA, 21 bp, Artificial Sequence
  Synthetic Oligonucleotide
caatttcacctaagtggtgat

SEQ ID NO: 911 - DNA, 20 bp, Artificial Sequence
  Synthetic Oligonucleotide
aaattgtacgtctttgtgct

SEQ ID NO: 912 - DNA, 22 bp, Artificial Sequence
  Synthetic Oligonucleotide
gaatttctactcgaacgtagat

SEQ ID NO: 913 - DNA, 22 bp, Artificial Sequence
  Synthetic Oligonucleotide
caatttctactcccccgtagat

SEQ ID NO: 914 - DNA, 22 bp, Artificial Sequence
  Synthetic Oligonucleotide
aaatttctactgcccagtagat

SEQ ID NO: 915 - DNA, 21 bp, Artificial Sequence
  Synthetic Oligonucleotide
caatttctcctacacggagat

SEQ ID NO: 916 - DNA, 22 bp, Artificial Sequence
  Synthetic Oligonucleotide
caatttctcctaatgcggagat

SEQ ID NO: 917 - DNA, 22 bp, Artificial Sequence
  Synthetic Oligonucleotide
caatttctactgtccagtagat

SEQ ID NO: 918 - DNA, 21 bp, Artificial Sequence
  Synthetic Oligonucleotide
caatttctactaatcgtagat

SEQ ID NO: 919 - DNA, 22 bp, Artificial Sequence
  Synthetic Oligonucleotide
caatttctactatgctgtagat

SEQ ID NO: 920 - DNA, 22 bp, Artificial Sequence
  Synthetic Oligonucleotide
aaatttctaccgttacgtagat

SEQ ID NO: 921 - DNA, 22 bp, Artificial Sequence
  Synthetic Oligonucleotide
caatttctacttagctgtagat

SEQ ID NO: 922 - DNA, 22 bp, Artificial Sequence
  Synthetic Oligonucleotide
caatttctactgtcctgtagat

SEQ ID NO: 923 - DNA, 22 bp, Artificial Sequence
  Synthetic Oligonucleotide
caatttctcctaccttggagat

SEQ ID NO: 924 - DNA, 22 bp, Artificial Sequence
  Synthetic Oligonucleotide
caatttctaccaacttgtagat

SEQ ID NO: 925 - DNA, 21 bp, Artificial Sequence
  Synthetic Oligonucleotide
aaatttctcctagacggagat

SEQ ID NO: 926 - DNA, 20 bp, Artificial Sequence
  Synthetic Oligonucleotide
gaatttctactcgtgtagat

SEQ ID NO: 927 - DNA, 21 bp, Artificial Sequence
  Synthetic Oligonucleotide
caatttctaccatttgtagat

SEQ ID NO: 928 - DNA, 22 bp, Artificial Sequence
  Synthetic Oligonucleotide
gaatttctactatcgtgtagat

SEQ ID NO: 929 - DNA, 22 bp, Artificial Sequence
  Synthetic Oligonucleotide
caatttctacttccacgtagat

SEQ ID NO: 930 - DNA, 21 bp, Artificial Sequence
  Synthetic Oligonucleotide
aaatttctcctaaggggagat

SEQ ID NO: 931 - DNA, 22 bp, Artificial Sequence
  Synthetic Oligonucleotide
caatttctactaaaacgtagat

SEQ ID NO: 932 - DNA, 22 bp, Artificial Sequence
  Synthetic Oligonucleotide
caatttctactatcgtgtagat

SEQ ID NO: 933 - DNA, 20 bp, Artificial Sequence
  Synthetic Oligonucleotide
gaattcctcctcttggaggt

SEQ ID NO: 934 - DNA, 22 bp, Artificial Sequence
  Synthetic Oligonucleotide
caatttctactaatgggtagat

SEQ ID NO: 935 - DNA, 21 bp, Artificial Sequence
  Synthetic Oligonucleotide
aaatttctacttcccgtagat

SEQ ID NO: 936 - DNA, 22 bp, Artificial Sequence
  Synthetic Oligonucleotide
caatttctactatgaggtagat

SEQ ID NO: 937 - DNA, 20 bp, Artificial Sequence
  Synthetic Oligonucleotide
caattccttgtcttcggggt

SEQ ID NO: 938 - DNA, 21 bp, Artificial Sequence
  Synthetic Oligonucleotide
caatttctactagatgtagat

SEQ ID NO: 939 - DNA, 22 bp, Artificial Sequence
  Synthetic Oligonucleotide
caatttctacttttgagtagat

SEQ ID NO: 940 - DNA, 21 bp, Artificial Sequence
  Synthetic Oligonucleotide
gaatttctactcagtgtagat

SEQ ID NO: 941 - DNA, 22 bp, Artificial Sequence
  Synthetic Oligonucleotide
gaatttctactaaagggtagat

SEQ ID NO: 942 - DNA, 22 bp, Artificial Sequence
  Synthetic Oligonucleotide
caatttctactaccacgtagat

SEQ ID NO: 943 - DNA, 22 bp, Artificial Sequence
  Synthetic Oligonucleotide
caatttctactatgttgtagat

SEQ ID NO: 944 - DNA, 22 bp, Artificial Sequence
  Synthetic Oligonucleotide
caatttctactattctgtagat

SEQ ID NO: 945 - DNA, 22 bp, Artificial Sequence
  Synthetic Oligonucleotide
caatttctactgtatcgtagat

SEQ ID NO: 946 - DNA, 21 bp, Artificial Sequence
  Synthetic Oligonucleotide
aaatttctactgctcgtagat

SEQ ID NO: 947 - DNA, 22 bp, Artificial Sequence
  Synthetic Oligonucleotide
caatttctactttgacgtagat

SEQ ID NO: 948 - DNA, 22 bp, Artificial Sequence
  Synthetic Oligonucleotide
gaatttctcctaaattggagat

SEQ ID NO: 949 - DNA, 20 bp, Artificial Sequence
  Synthetic Oligonucleotide
gaatttctactcgggtagat

SEQ ID NO: 950 - DNA, 21 bp, Artificial Sequence
  Synthetic Oligonucleotide
caatttctcctatctggagat

SEQ ID NO: 951 - DNA, 22 bp, Artificial Sequence
  Synthetic Oligonucleotide
gaatttctactatctagtagat

SEQ ID NO: 952 - DNA, 22 bp, Artificial Sequence
  Synthetic Oligonucleotide
caatttctcctacgatggagat

SEQ ID NO: 953 - DNA, 22 bp, Artificial Sequence
  Synthetic Oligonucleotide
caatttctacttggtggtagat

SEQ ID NO: 954 - DNA, 22 bp, Artificial Sequence
  Synthetic Oligonucleotide
caatttctacctatgcgtagat

SEQ ID NO: 955 - DNA, 22 bp, Artificial Sequence
  Synthetic Oligonucleotide
caatttctactgcgatgtagat

SEQ ID NO: 956 - DNA, 22 bp, Artificial Sequence
  Synthetic Oligonucleotide
caatttctactttgaagtagat

SEQ ID NO: 957 - DNA, 22 bp, Artificial Sequence
  Synthetic Oligonucleotide
caatttctactcatgcgtagat

SEQ ID NO: 958 - DNA, 22 bp, Artificial Sequence
  Synthetic Oligonucleotide
caatttctaccttttggtagat

SEQ ID NO: 959 - DNA, 22 bp, Artificial Sequence
  Synthetic Oligonucleotide
caatttctactaatcggtagat

SEQ ID NO: 960 - DNA, 22 bp, Artificial Sequence
  Synthetic Oligonucleotide
gaatttctactacgcggtagat

SEQ ID NO: 961 - DNA, 22 bp, Artificial Sequence
  Synthetic Oligonucleotide
caatttctactcctttgtagat

SEQ ID NO: 962 - DNA, 20 bp, Artificial Sequence
  Synthetic Oligonucleotide
caattcctgttcttgtgggt

SEQ ID NO: 963 - DNA, 22 bp, Artificial Sequence
  Synthetic Oligonucleotide
aaatttctactttgtggtagat

SEQ ID NO: 964 - DNA, 22 bp, Artificial Sequence
  Synthetic Oligonucleotide
caatttctactgttgtgtagat

SEQ ID NO: 965 - DNA, 22 bp, Artificial Sequence
  Synthetic Oligonucleotide
caatttctactgactggtagat

SEQ ID NO: 966 - DNA, 22 bp, Artificial Sequence
  Synthetic Oligonucleotide
gaatttctactcttgtgtagat

SEQ ID NO: 967 - DNA, 22 bp, Artificial Sequence
  Synthetic Oligonucleotide
caatttctactttgatgtagat

SEQ ID NO: 968 - DNA, 22 bp, Artificial Sequence
  Synthetic Oligonucleotide
gaatttctactgatcagtagat

SEQ ID NO: 969 - DNA, 21 bp, Artificial Sequence
  Synthetic Oligonucleotide
caatttctacttacagtagat

SEQ ID NO: 970 - DNA, 22 bp, Artificial Sequence
  Synthetic Oligonucleotide
gaatttctactgctttgtagat

SEQ ID NO: 971 - DNA, 22 bp, Artificial Sequence
  Synthetic Oligonucleotide
gaatttctacttccctgtagat

SEQ ID NO: 972 - DNA, 22 bp, Artificial Sequence
  Synthetic Oligonucleotide
caatttctactgtttcgtagat

SEQ ID NO: 973 - DNA, 22 bp, Artificial Sequence
  Synthetic Oligonucleotide
caatttctacttcgcagtagat

SEQ ID NO: 974 - DNA, 21 bp, Artificial Sequence
  Synthetic Oligonucleotide
gaattccgcctaagtggcggt

SEQ ID NO: 975 - DNA, 20 bp, Artificial Sequence
  Synthetic Oligonucleotide
gaatttctactggggtagat

SEQ ID NO: 976 - DNA, 21 bp, Artificial Sequence
  Synthetic Oligonucleotide
caatttctcctaagtggagat

SEQ ID NO: 977 - DNA, 20 bp, Artificial Sequence
  Synthetic Oligonucleotide
caatttctactcaggtagat

SEQ ID NO: 978 - DNA, 22 bp, Artificial Sequence
  Synthetic Oligonucleotide
gaatttctacaacatcgtagat

SEQ ID NO: 979 - DNA, 21 bp, Artificial Sequence
  Synthetic Oligonucleotide
caatttctcctaggaggagat

SEQ ID NO: 980 - DNA, 21 bp, Artificial Sequence
  Synthetic Oligonucleotide
caattttgactaagtgtcgat

SEQ ID NO: 981 - DNA, 22 bp, Artificial Sequence
  Synthetic Oligonucleotide
caatttctcctacatcggagat

SEQ ID NO: 982 - DNA, 21 bp, Artificial Sequence
  Synthetic Oligonucleotide
caatttctacttgacgtagat

SEQ ID NO: 983 - DNA, 20 bp, Artificial Sequence
  Synthetic Oligonucleotide
caatttctcctagtggagat

SEQ ID NO: 984 - DNA, 22 bp, Artificial Sequence
  Synthetic Oligonucleotide
gaatttctactgggacgtagat

SEQ ID NO: 985 - DNA, 21 bp, Artificial Sequence
  Synthetic Oligonucleotide
gaatttctacttggtgtagat

SEQ ID NO: 986 - DNA, 22 bp, Artificial Sequence
  Synthetic Oligonucleotide
caatttctactattcggtagat

SEQ ID NO: 987 - DNA, 22 bp, Artificial Sequence
  Synthetic Oligonucleotide
aaatttctactcttgcgtagat

SEQ ID NO: 988 - DNA, 22 bp, Artificial Sequence
  Synthetic Oligonucleotide
aaatttctactctggagtagat

SEQ ID NO: 989 - DNA, 22 bp, Artificial Sequence
  Synthetic Oligonucleotide
gaatttctactctggtgtagat

SEQ ID NO: 990 - DNA, 22 bp, Artificial Sequence
  Synthetic Oligonucleotide
gaatttctactgacgtgtagat

SEQ ID NO: 991 - DNA, 22 bp, Artificial Sequence
  Synthetic Oligonucleotide
aaatttctactagagcgtagat

SEQ ID NO: 992 - DNA, 21 bp, Artificial Sequence
  Synthetic Oligonucleotide
caatttctcctatccggagat

SEQ ID NO: 993 - DNA, 21 bp, Artificial Sequence
  Synthetic Oligonucleotide
caatttctcctacgaggagat

SEQ ID NO: 994 - DNA, 22 bp, Artificial Sequence
  Synthetic Oligonucleotide
caatttctactacactgtagat

SEQ ID NO: 995 - DNA, 22 bp, Artificial Sequence
  Synthetic Oligonucleotide
gaatttctactctgccgtagat

SEQ ID NO: 996 - DNA, 22 bp, Artificial Sequence
  Synthetic Oligonucleotide
caatttctactgcagcgtagat

SEQ ID NO: 997 - DNA, 22 bp, Artificial Sequence
  Synthetic Oligonucleotide
caatttctactagcaagtagat

SEQ ID NO: 998 - DNA, 20 bp, Artificial Sequence
  Synthetic Oligonucleotide
gaatttctactgtcgtagat

SEQ ID NO: 999 - DNA, 21 bp, Artificial Sequence
  Synthetic Oligonucleotide
caatttctcctatcaggagat

SEQ ID NO: 1000 - DNA, 22 bp, Artificial Sequence
  Synthetic Oligonucleotide
gaatttctactcaattgtagat

SEQ ID NO: 1001 - DNA, 22 bp, Artificial Sequence
  Synthetic Oligonucleotide
caatttctcctaaggaggagat

SEQ ID NO: 1002 - DNA, 22 bp, Artificial Sequence
  Synthetic Oligonucleotide
caatttctactctcgagtagat

SEQ ID NO: 1003 - DNA, 21 bp, Artificial Sequence
  Synthetic Oligonucleotide
gaatttctactgcttgtagat

SEQ ID NO: 1004 - DNA, 22 bp, Artificial Sequence
  Synthetic Oligonucleotide
caatttctacttgttggtagat

SEQ ID NO: 1005 - DNA, 20 bp, Artificial Sequence
  Synthetic Oligonucleotide
caatttctacttaggtagat

SEQ ID NO: 1006 - DNA, 22 bp, Artificial Sequence
  Synthetic Oligonucleotide
caatttctacttcgccgtagat

SEQ ID NO: 1007 - DNA, 22 bp, Artificial Sequence
  Synthetic Oligonucleotide
caatttctactactttgtagat

SEQ ID NO: 1008 - DNA, 22 bp, Artificial Sequence
  Synthetic Oligonucleotide
gaatttctacttttcggtagat

SEQ ID NO: 1009 - DNA, 22 bp, Artificial Sequence
  Synthetic Oligonucleotide
caatttctactacatagtagat

SEQ ID NO: 1010 - DNA, 21 bp, Artificial Sequence
  Synthetic Oligonucleotide
caatttctactagtggtagat

SEQ ID NO: 1011 - DNA, 22 bp, Artificial Sequence
  Synthetic Oligonucleotide
caatttctactcactagtagat

SEQ ID NO: 1012 - DNA, 20 bp, Artificial Sequence
  Synthetic Oligonucleotide
caatttctactttagtagat

SEQ ID NO: 1013 - DNA, 21 bp, Artificial Sequence
  Synthetic Oligonucleotide
caatttcttctaagtgaagat

SEQ ID NO: 1014 - DNA, 20 bp, Artificial Sequence
  Synthetic Oligonucleotide
caatttctactcgagtagat

SEQ ID NO: 1015 - DNA, 22 bp, Artificial Sequence
  Synthetic Oligonucleotide
caatttctacttggcagtagat

SEQ ID NO: 1016 - DNA, 22 bp, Artificial Sequence
  Synthetic Oligonucleotide
gaatttctactgccatgtagat

SEQ ID NO: 1017 - DNA, 22 bp, Artificial Sequence
  Synthetic Oligonucleotide
caatttctactacttcgtagat

SEQ ID NO: 1018 - DNA, 22 bp, Artificial Sequence
  Synthetic Oligonucleotide
aaatttctactcagtcgtagat

SEQ ID NO: 1019 - DNA, 21 bp, Artificial Sequence
  Synthetic Oligonucleotide
caatttctcctgtgaggagat

SEQ ID NO: 1020 - DNA, 21 bp, Artificial Sequence
  Synthetic Oligonucleotide
caatttctactgtgtgtagat

SEQ ID NO: 1021 - DNA, 21 bp, Artificial Sequence
  Synthetic Oligonucleotide
caatttctacttctggtagat

SEQ ID NO: 1022 - DNA, 22 bp, Artificial Sequence
  Synthetic Oligonucleotide
caatttctactacccggtagat

SEQ ID NO: 1023 - DNA, 22 bp, Artificial Sequence
  Synthetic Oligonucleotide
caatttctactcgtgcgtagat

SEQ ID NO: 1024 - DNA, 20 bp, Artificial Sequence
  Synthetic Oligonucleotide
caatttctactggtgtagat

SEQ ID NO: 1025 - DNA, 20 bp, Artificial Sequence
  Synthetic Oligonucleotide
caattagcggtcttttgctt

SEQ ID NO: 1026 - DNA, 21 bp, Artificial Sequence
  Synthetic Oligonucleotide
gaatttctacttggcgtagat

SEQ ID NO: 1027 - DNA, 21 bp, Artificial Sequence
  Synthetic Oligonucleotide
caatttctgctaagtgtagat

SEQ ID NO: 1028 - DNA, 22 bp, Artificial Sequence
  Synthetic Oligonucleotide
gaatttctactctcgtgtagat

SEQ ID NO: 1029 - DNA, 21 bp, Artificial Sequence
  Synthetic Oligonucleotide
caatttctcctaacaggagat

SEQ ID NO: 1030 - DNA, 22 bp, Artificial Sequence
  Synthetic Oligonucleotide
aaatttctactgtgtggtagat

SEQ ID NO: 1031 - DNA, 22 bp, Artificial Sequence
  Synthetic Oligonucleotide
aaatttctactagcgagtagat

SEQ ID NO: 1032 - DNA, 22 bp, Artificial Sequence
  Synthetic Oligonucleotide
caatttctactatgcagtagat

SEQ ID NO: 1033 - DNA, 22 bp, Artificial Sequence
  Synthetic Oligonucleotide
caatttctactaaggggtagat

SEQ ID NO: 1034 - DNA, 22 bp, Artificial Sequence
  Synthetic Oligonucleotide
caatttctactgcagagtagat

SEQ ID NO: 1035 - DNA, 22 bp, Artificial Sequence
  Synthetic Oligonucleotide
gaatttctacttagttgtagat

SEQ ID NO: 1036 - DNA, 21 bp, Artificial Sequence
  Synthetic Oligonucleotide
caatttctacttaccgtagat

SEQ ID NO: 1037 - DNA, 22 bp, Artificial Sequence
  Synthetic Oligonucleotide
caatttctcctactggggagat

SEQ ID NO: 1038 - DNA, 22 bp, Artificial Sequence
  Synthetic Oligonucleotide
gaatttctacgaactagtagat

SEQ ID NO: 1039 - DNA, 22 bp, Artificial Sequence
  Synthetic Oligonucleotide
caatttctactacagtgtagat

SEQ ID NO: 1040 - DNA, 22 bp, Artificial Sequence
  Synthetic Oligonucleotide
caatttctactgctgtgtagat

SEQ ID NO: 1041 - DNA, 20 bp, Artificial Sequence
  Synthetic Oligonucleotide
caatttctactactgtagat

SEQ ID NO: 1042 - DNA, 22 bp, Artificial Sequence
  Synthetic Oligonucleotide
caatttctacttagaagtagat

SEQ ID NO: 1043 - DNA, 22 bp, Artificial Sequence
  Synthetic Oligonucleotide
aaatttctactcaagtgtagat

SEQ ID NO: 1044 - DNA, 22 bp, Artificial Sequence
  Synthetic Oligonucleotide
caatttctactttggcgtagat

SEQ ID NO: 1045 - DNA, 22 bp, Artificial Sequence
  Synthetic Oligonucleotide
aaatttctacttgtgagtagat

SEQ ID NO: 1046 - DNA, 22 bp, Artificial Sequence
  Synthetic Oligonucleotide
gaatttctactcctacgtagat

SEQ ID NO: 1047 - DNA, 21 bp, Artificial Sequence
  Synthetic Oligonucleotide
gaatttctacgcatggtagat

SEQ ID NO: 1048 - DNA, 21 bp, Artificial Sequence
  Synthetic Oligonucleotide
caatttctccttcgtggagat

SEQ ID NO: 1049 - DNA, 21 bp, Artificial Sequence
  Synthetic Oligonucleotide
gaatttctcctaaatggagat

SEQ ID NO: 1050 - DNA, 22 bp, Artificial Sequence
  Synthetic Oligonucleotide
gaatttctcctaccgtggagat

SEQ ID NO: 1051 - DNA, 22 bp, Artificial Sequence
  Synthetic Oligonucleotide
caatttctcctgttgtggagat

SEQ ID NO: 1052 - DNA, 21 bp, Artificial Sequence
  Synthetic Oligonucleotide
caatttctcctagcaggagat

SEQ ID NO: 1053 - DNA, 22 bp, Artificial Sequence
  Synthetic Oligonucleotide
aaatttctactggcgagtagat

SEQ ID NO: 1054 - DNA, 22 bp, Artificial Sequence
  Synthetic Oligonucleotide
caatttctactggatagtagat

SEQ ID NO: 1055 - DNA, 22 bp, Artificial Sequence
  Synthetic Oligonucleotide
caatttctactctcttgtagat

SEQ ID NO: 1056 - DNA, 22 bp, Artificial Sequence
  Synthetic Oligonucleotide
caatttctacttagtagtagat

SEQ ID NO: 1057 - DNA, 22 bp, Artificial Sequence
  Synthetic Oligonucleotide
caatttctacttccgcgtagat

SEQ ID NO: 1058 - DNA, 21 bp, Artificial Sequence
  Synthetic Oligonucleotide
caatttctcctacaaggagat

SEQ ID NO: 1059 - DNA, 22 bp, Artificial Sequence
  Synthetic Oligonucleotide
caatttctacttgtaggtagat

SEQ ID NO: 1060 - DNA, 22 bp, Artificial Sequence
  Synthetic Oligonucleotide
gaatttctactgggctgtagat

SEQ ID NO: 1061 - DNA, 22 bp, Artificial Sequence
  Synthetic Oligonucleotide
caatttctactcgttcgtagat

SEQ ID NO: 1062 - DNA, 21 bp, Artificial Sequence
  Synthetic Oligonucleotide
gaatttctactacccgtagat

SEQ ID NO: 1063 - DNA, 22 bp, Artificial Sequence
  Synthetic Oligonucleotide
caatttctactagcatgtagat

SEQ ID NO: 1064 - DNA, 21 bp, Artificial Sequence
  Synthetic Oligonucleotide
caatttaccttaagtaggtgt

SEQ ID NO: 1065 - DNA, 21 bp, Artificial Sequence
  Synthetic Oligonucleotide
caatttctactccgtgtagat

SEQ ID NO: 1066 - DNA, 20 bp, Artificial Sequence
  Synthetic Oligonucleotide
caattctgtttcttaacggt

SEQ ID NO: 1067 - DNA, 21 bp, Artificial Sequence
  Synthetic Oligonucleotide
gaatttctacgagtagtagat

SEQ ID NO: 1068 - DNA, 21 bp, Artificial Sequence
  Synthetic Oligonucleotide
caatttctactagtagtagat

SEQ ID NO: 1069 - DNA, 22 bp, Artificial Sequence
  Synthetic Oligonucleotide
caatttctactaacgcgtagat

SEQ ID NO: 1070 - DNA, 22 bp, Artificial Sequence
  Synthetic Oligonucleotide
caatttctactgtcatgtagat

SEQ ID NO: 1071 - DNA, 21 bp, Artificial Sequence
  Synthetic Oligonucleotide
caatttctactacacgtagat

SEQ ID NO: 1072 - DNA, 21 bp, Artificial Sequence
  Synthetic Oligonucleotide
caatttctactatcggtagat

SEQ ID NO: 1073 - DNA, 20 bp, Artificial Sequence
  Synthetic Oligonucleotide
caatttctactgctgtagat

SEQ ID NO: 1074 - DNA, 21 bp, Artificial Sequence
  Synthetic Oligonucleotide
caatttctacctcttgtagat

SEQ ID NO: 1075 - DNA, 22 bp, Artificial Sequence
  Synthetic Oligonucleotide
caatttctactgcgacgtagat

SEQ ID NO: 1076 - DNA, 22 bp, Artificial Sequence
  Synthetic Oligonucleotide
gaatttctactaggctgtagat

SEQ ID NO: 1077 - DNA, 21 bp, Artificial Sequence
  Synthetic Oligonucleotide
aaatttctactaaacgtagat

SEQ ID NO: 1078 - DNA, 22 bp, Artificial Sequence
  Synthetic Oligonucleotide
gaatttctcctagggtggagat

SEQ ID NO: 1079 - DNA, 22 bp, Artificial Sequence
  Synthetic Oligonucleotide
caatttctactctaccgtagat

SEQ ID NO: 1080 - DNA, 21 bp, Artificial Sequence
  Synthetic Oligonucleotide
caatttctactttccgtagat

SEQ ID NO: 1081 - DNA, 22 bp, Artificial Sequence
  Synthetic Oligonucleotide
caatttctactctcaggtagat

SEQ ID NO: 1082 - DNA, 22 bp, Artificial Sequence
  Synthetic Oligonucleotide
caatttctactgcgctgtagat

SEQ ID NO: 1083 - DNA, 22 bp, Artificial Sequence
  Synthetic Oligonucleotide
gaatttctactcacgggtagat

SEQ ID NO: 1084 - DNA, 22 bp, Artificial Sequence
  Synthetic Oligonucleotide
caatttctacttaggcgtagat

SEQ ID NO: 1085 - DNA, 21 bp, Artificial Sequence
  Synthetic Oligonucleotide
caatttctaccagttgtagat

SEQ ID NO: 1086 - DNA, 22 bp, Artificial Sequence
  Synthetic Oligonucleotide
gaatttctactatcgggtagat

SEQ ID NO: 1087 - DNA, 20 bp, Artificial Sequence
  Synthetic Oligonucleotide
caatttctactcccgtagat

SEQ ID NO: 1088 - DNA, 22 bp, Artificial Sequence
  Synthetic Oligonucleotide
caatttctactacgcagtagat

SEQ ID NO: 1089 - DNA, 21 bp, Artificial Sequence
  Synthetic Oligonucleotide
caatttctacttcatgtagat

SEQ ID NO: 1090 - DNA, 22 bp, Artificial Sequence
  Synthetic Oligonucleotide
caatttctcctatagtggagat

SEQ ID NO: 1091 - DNA, 22 bp, Artificial Sequence
  Synthetic Oligonucleotide
caatttctcctagcctggagat

SEQ ID NO: 1092 - DNA, 22 bp, Artificial Sequence
  Synthetic Oligonucleotide
gaatttctactcatccgtagat

SEQ ID NO: 1093 - DNA, 22 bp, Artificial Sequence
  Synthetic Oligonucleotide
caatttctactcccaagtagat

SEQ ID NO: 1094 - DNA, 22 bp, Artificial Sequence
  Synthetic Oligonucleotide
caatttctcctatcggggagat

SEQ ID NO: 1095 - DNA, 20 bp, Artificial Sequence
  Synthetic Oligonucleotide
caattatgcgtctttgtgtt

SEQ ID NO: 1096 - DNA, 22 bp, Artificial Sequence
  Synthetic Oligonucleotide
caatttctactcgtccgtagat

SEQ ID NO: 1097 - DNA, 21 bp, Artificial Sequence
  Synthetic Oligonucleotide
caatttctactcctcgtagat

SEQ ID NO: 1098 - DNA, 22 bp, Artificial Sequence
  Synthetic Oligonucleotide
caatttctactccattgtagat

SEQ ID NO: 1099 - DNA, 20 bp, Artificial Sequence
  Synthetic Oligonucleotide
caatttctactcacgtagat

SEQ ID NO: 1100 - DNA, 22 bp, Artificial Sequence
  Synthetic Oligonucleotide
caatttctacttattcgtagat

SEQ ID NO: 1101 - DNA, 22 bp, Artificial Sequence
  Synthetic Oligonucleotide
caatttctacttctgagtagat

SEQ ID NO: 1102 - DNA, 21 bp, Artificial Sequence
  Synthetic Oligonucleotide
caatttctccttagcggagat

SEQ ID NO: 1103 - DNA, 21 bp, Artificial Sequence
  Synthetic Oligonucleotide
caatttctactgtttgtagat

SEQ ID NO: 1104 - DNA, 21 bp, Artificial Sequence
  Synthetic Oligonucleotide
caatttctacttatagtagat

SEQ ID NO: 1105 - DNA, 22 bp, Artificial Sequence
  Synthetic Oligonucleotide
aaatttctactgcgtcgtagat

SEQ ID NO: 1106 - DNA, 21 bp, Artificial Sequence
  Synthetic Oligonucleotide
caatttctcctacttggagat

SEQ ID NO: 1107 - DNA, 21 bp, Artificial Sequence
  Synthetic Oligonucleotide
gaatttctcctctctggagat

SEQ ID NO: 1108 - DNA, 22 bp, Artificial Sequence
  Synthetic Oligonucleotide
caatttctactcgtaagtagat

SEQ ID NO: 1109 - DNA, 22 bp, Artificial Sequence
  Synthetic Oligonucleotide
gaatttctacttggcggtagat

SEQ ID NO: 1110 - DNA, 22 bp, Artificial Sequence
  Synthetic Oligonucleotide
caatttctactgccttgtagat

SEQ ID NO: 1111 - DNA, 21 bp, Artificial Sequence
  Synthetic Oligonucleotide
aaatttctcctacctggagat

SEQ ID NO: 1112 - DNA, 21 bp, Artificial Sequence
  Synthetic Oligonucleotide
aaatttctactgcaagtagat

SEQ ID NO: 1113 - DNA, 22 bp, Artificial Sequence
  Synthetic Oligonucleotide
caatttctactgggacgtagat

SEQ ID NO: 1114 - DNA, 22 bp, Artificial Sequence
  Synthetic Oligonucleotide
caatttctactacaacgtagat

SEQ ID NO: 1115 - DNA, 22 bp, Artificial Sequence
  Synthetic Oligonucleotide
caatttctactgcagtgtagat

SEQ ID NO: 1116 - DNA, 22 bp, Artificial Sequence
  Synthetic Oligonucleotide
caatttctactccatcgtagat

SEQ ID NO: 1117 - DNA, 21 bp, Artificial Sequence
  Synthetic Oligonucleotide
caatttctactgaaggtagat

SEQ ID NO: 1118 - DNA, 22 bp, Artificial Sequence
  Synthetic Oligonucleotide
caatttctactgtagagtagat

SEQ ID NO: 1119 - DNA, 22 bp, Artificial Sequence
  Synthetic Oligonucleotide
aaatttctactcacacgtagat

SEQ ID NO: 1120 - DNA, 21 bp, Artificial Sequence
  Synthetic Oligonucleotide
caatttctactagtcgtagat

SEQ ID NO: 1121 - DNA, 22 bp, Artificial Sequence
  Synthetic Oligonucleotide
caatttctcctaaggcggagat

SEQ ID NO: 1122 - DNA, 21 bp, Artificial Sequence
  Synthetic Oligonucleotide
gaatttctactgctcgtagat

SEQ ID NO: 1123 - DNA, 21 bp, Artificial Sequence
  Synthetic Oligonucleotide
gaatttctaccagttgtagat

SEQ ID NO: 1124 - DNA, 22 bp, Artificial Sequence
  Synthetic Oligonucleotide
caatttctcctatcgtggagat

SEQ ID NO: 1125 - DNA, 21 bp, Artificial Sequence
  Synthetic Oligonucleotide
caatttctactctcggtagat

SEQ ID NO: 1126 - DNA, 22 bp, Artificial Sequence
  Synthetic Oligonucleotide
caatttctcctaagacggagat

SEQ ID NO: 1127 - DNA, 21 bp, Artificial Sequence
  Synthetic Oligonucleotide
gaatttctcctcggtggagat

SEQ ID NO: 1128 - DNA, 22 bp, Artificial Sequence
  Synthetic Oligonucleotide
caatttctacttatgcgtagat

SEQ ID NO: 1129 - DNA, 21 bp, Artificial Sequence
  Synthetic Oligonucleotide
caattttgcctaagtggcgat

SEQ ID NO: 1130 - DNA, 22 bp, Artificial Sequence
  Synthetic Oligonucleotide
caatttctacgcaaaagtagat

SEQ ID NO: 1131 - DNA, 22 bp, Artificial Sequence
  Synthetic Oligonucleotide
caatttctacttgaaggtagat

SEQ ID NO: 1132 - DNA, 21 bp, Artificial Sequence
  Synthetic Oligonucleotide
caatttctacttggtgtagat

SEQ ID NO: 1133 - DNA, 21 bp, Artificial Sequence
  Synthetic Oligonucleotide
gaatttctactggaagtagat

SEQ ID NO: 1134 - DNA, 22 bp, Artificial Sequence
  Synthetic Oligonucleotide
caatttctactaccttgtagat

SEQ ID NO: 1135 - DNA, 22 bp, Artificial Sequence
  Synthetic Oligonucleotide
gaatttctacaccctagtagat

SEQ ID NO: 1136 - DNA, 22 bp, Artificial Sequence
  Synthetic Oligonucleotide
gaatttctccttgtcgggagat

SEQ ID NO: 1137 - DNA, 21 bp, Artificial Sequence
  Synthetic Oligonucleotide
caattggaggtaagtcctcct

SEQ ID NO: 1138 - DNA, 22 bp, Artificial Sequence
  Synthetic Oligonucleotide
aaatttctacgccgtggtagat

SEQ ID NO: 1139 - DNA, 22 bp, Artificial Sequence
  Synthetic Oligonucleotide
aaatttctacttactggtagat

SEQ ID NO: 1140 - DNA, 21 bp, Artificial Sequence
  Synthetic Oligonucleotide
caatttctcctgtttggagat

SEQ ID NO: 1141 - DNA, 21 bp, Artificial Sequence
  Synthetic Oligonucleotide
caatttctcctaggcggagat

SEQ ID NO: 1142 - DNA, 22 bp, Artificial Sequence
  Synthetic Oligonucleotide
aaatttctactgatgggtagat

SEQ ID NO: 1143 - DNA, 20 bp, Artificial Sequence
  Synthetic Oligonucleotide
caattcctcctcttggaggt

SEQ ID NO: 1144 - DNA, 22 bp, Artificial Sequence
  Synthetic Oligonucleotide
caatttctcctagcgaggagat

SEQ ID NO: 1145 - DNA, 21 bp, Artificial Sequence
  Synthetic Oligonucleotide
aaatttctactggccgtagat

SEQ ID NO: 1146 - DNA, 21 bp, Artificial Sequence
  Synthetic Oligonucleotide
caatttatgataagttcgtat

SEQ ID NO: 1147 - DNA, 22 bp, Artificial Sequence
  Synthetic Oligonucleotide
gaatttctcctacggcggagat

SEQ ID NO: 1148 - DNA, 22 bp, Artificial Sequence
  Synthetic Oligonucleotide
aaatttctcctgacgtggagat

SEQ ID NO: 1149 - DNA, 22 bp, Artificial Sequence
  Synthetic Oligonucleotide
caatttctactgacaagtagat

SEQ ID NO: 1150 - DNA, 20 bp, Artificial Sequence
  Synthetic Oligonucleotide
caatttgtcttcttaggtgt

SEQ ID NO: 1151 - DNA, 21 bp, Artificial Sequence
  Synthetic Oligonucleotide
aaattgtgcgtaagttgcgtt

SEQ ID NO: 1152 - DNA, 21 bp, Artificial Sequence
  Synthetic Oligonucleotide
gaatttctacttcgcgtagat

SEQ ID NO: 1153 - DNA, 22 bp, Artificial Sequence
  Synthetic Oligonucleotide
caatttctactggtaagtagat

SEQ ID NO: 1154 - DNA, 21 bp, Artificial Sequence
  Synthetic Oligonucleotide
caatttctacttgcagtagat

SEQ ID NO: 1155 - DNA, 22 bp, Artificial Sequence
  Synthetic Oligonucleotide
caatttctacttgcaagtagat

SEQ ID NO: 1156 - DNA, 22 bp, Artificial Sequence
  Synthetic Oligonucleotide
caatttctactggaacgtagat

SEQ ID NO: 1157 - DNA, 22 bp, Artificial Sequence
  Synthetic Oligonucleotide
caatttctactccttggtagat

SEQ ID NO: 1158 - DNA, 22 bp, Artificial Sequence
  Synthetic Oligonucleotide
caatttctacgcacccgtagat

SEQ ID NO: 1159 - DNA, 22 bp, Artificial Sequence
  Synthetic Oligonucleotide
caatttctactggattgtagat

SEQ ID NO: 1160 - DNA, 22 bp, Artificial Sequence
  Synthetic Oligonucleotide
gaatttctacttctcggtagat

SEQ ID NO: 1161 - DNA, 21 bp, Artificial Sequence
  Synthetic Oligonucleotide
caatttctactgtacgtagat

SEQ ID NO: 1162 - DNA, 22 bp, Artificial Sequence
  Synthetic Oligonucleotide
caatttctactctactgtagat

SEQ ID NO: 1163 - DNA, 22 bp, Artificial Sequence
  Synthetic Oligonucleotide
gaatttctactccacagtagat

SEQ ID NO: 1164 - DNA, 22 bp, Artificial Sequence
  Synthetic Oligonucleotide
caatttctactgagaggtagat

SEQ ID NO: 1165 - DNA, 21 bp, Artificial Sequence
  Synthetic Oligonucleotide
caatttctactataggtagat

SEQ ID NO: 1166 - DNA, 20 bp, Artificial Sequence
  Synthetic Oligonucleotide
caattgtgtatctttatgct

SEQ ID NO: 1167 - DNA, 22 bp, Artificial Sequence
  Synthetic Oligonucleotide
caatttctactcgagagtagat

SEQ ID NO: 1168 - DNA, 21 bp, Artificial Sequence
  Synthetic Oligonucleotide
caatttctactggcagtagat

SEQ ID NO: 1169 - DNA, 22 bp, Artificial Sequence
  Synthetic Oligonucleotide
caatttctacttacccgtagat

SEQ ID NO: 1170 - DNA, 22 bp, Artificial Sequence
  Synthetic Oligonucleotide
aaatttctactcaagggtagat

SEQ ID NO: 1171 - DNA, 22 bp, Artificial Sequence
  Synthetic Oligonucleotide
caatttctactcaagggtagat

SEQ ID NO: 1172 - DNA, 22 bp, Artificial Sequence
  Synthetic Oligonucleotide
caatttctacttctaggtagat

SEQ ID NO: 1173 - DNA, 21 bp, Artificial Sequence
  Synthetic Oligonucleotide
caatttctaccaattgtagat

SEQ ID NO: 1174 - DNA, 22 bp, Artificial Sequence
  Synthetic Oligonucleotide
caatttctactctcatgtagat

SEQ ID NO: 1175 - DNA, 22 bp, Artificial Sequence
  Synthetic Oligonucleotide
aaatttctactcaatggtagat

SEQ ID NO: 1176 - DNA, 22 bp, Artificial Sequence
  Synthetic Oligonucleotide
caatttctactgtgacgtagat

SEQ ID NO: 1177 - DNA, 22 bp, Artificial Sequence
  Synthetic Oligonucleotide
caatttctcctactgaggagat

SEQ ID NO: 1178 - DNA, 20 bp, Artificial Sequence
  Synthetic Oligonucleotide
caatttctactaaggtagat

SEQ ID NO: 1179 - DNA, 22 bp, Artificial Sequence
  Synthetic Oligonucleotide
caatttctactgcaaggtagat

SEQ ID NO: 1180 - DNA, 20 bp, Artificial Sequence
  Synthetic Oligonucleotide
caattattcgtctttgaatt

SEQ ID NO: 1181 - DNA, 22 bp, Artificial Sequence
  Synthetic Oligonucleotide
caatttctactactccgtagat

SEQ ID NO: 1182 - DNA, 22 bp, Artificial Sequence
  Synthetic Oligonucleotide
caatttctcctaagctggagat

SEQ ID NO: 1183 - DNA, 22 bp, Artificial Sequence
  Synthetic Oligonucleotide
caatttctacttgatcgtagat

SEQ ID NO: 1184 - DNA, 22 bp, Artificial Sequence
  Synthetic Oligonucleotide
gaatttctactctgtcgtagat

SEQ ID NO: 1185 - DNA, 22 bp, Artificial Sequence
  Synthetic Oligonucleotide
caatttctactccagcgtagat

SEQ ID NO: 1186 - DNA, 22 bp, Artificial Sequence
  Synthetic Oligonucleotide
gaatttctacgtaggcgtagat

SEQ ID NO: 1187 - DNA, 22 bp, Artificial Sequence
  Synthetic Oligonucleotide
caatttctacttcgaggtagat

SEQ ID NO: 1188 - DNA, 22 bp, Artificial Sequence
  Synthetic Oligonucleotide
gaatttctacttcggtgtagat

SEQ ID NO: 1189 - DNA, 22 bp, Artificial Sequence
  Synthetic Oligonucleotide
caatttctactcccgcgtagat

SEQ ID NO: 1190 - DNA, 22 bp, Artificial Sequence
  Synthetic Oligonucleotide
caatttctactacttggtagat

SEQ ID NO: 1191 - DNA, 21 bp, Artificial Sequence
  Synthetic Oligonucleotide
aaattgcgtgtaagttacgct

SEQ ID NO: 1192 - DNA, 21 bp, Artificial Sequence
  Synthetic Oligonucleotide
aaattgcgactaagtgttgct

SEQ ID NO: 1193 - DNA, 21 bp, Artificial Sequence
  Synthetic Oligonucleotide
gaatttctactctctgtagat

SEQ ID NO: 1194 - DNA, 20 bp, Artificial Sequence
  Synthetic Oligonucleotide
caatttgcattcttgtgcat

SEQ ID NO: 1195 - DNA, 21 bp, Artificial Sequence
  Synthetic Oligonucleotide
caatttctaccaacggtagat

SEQ ID NO: 1196 - DNA, 22 bp, Artificial Sequence
  Synthetic Oligonucleotide
gaatttctactacgtggtagat

SEQ ID NO: 1197 - DNA, 22 bp, Artificial Sequence
  Synthetic Oligonucleotide
caatttctactagcgcgtagat

SEQ ID NO: 1198 - DNA, 22 bp, Artificial Sequence
  Synthetic Oligonucleotide
caatttctactgtgccgtagat

SEQ ID NO: 1199 - DNA, 22 bp, Artificial Sequence
  Synthetic Oligonucleotide
aaatttctccactagtggagat

SEQ ID NO: 1200 - DNA, 21 bp, Artificial Sequence
  Synthetic Oligonucleotide
gaatttctacggcaagtagat

SEQ ID NO: 1201 - DNA, 22 bp, Artificial Sequence
  Synthetic Oligonucleotide
aaatttctaccctgatgtagat

SEQ ID NO: 1202 - DNA, 21 bp, Artificial Sequence
  Synthetic Oligonucleotide
aaatttctcctcggtggagat

SEQ ID NO: 1203 - DNA, 22 bp, Artificial Sequence
  Synthetic Oligonucleotide
gaatttctactgttgggtagat

SEQ ID NO: 1204 - DNA, 21 bp, Artificial Sequence
  Synthetic Oligonucleotide
caatttctactgagtgtagat

SEQ ID NO: 1205 - DNA, 22 bp, Artificial Sequence
  Synthetic Oligonucleotide
gaatttctacttttgtgtagat

SEQ ID NO: 1206 - DNA, 22 bp, Artificial Sequence
  Synthetic Oligonucleotide
gaatttctcctacatcggagat

SEQ ID NO: 1207 - DNA, 21 bp, Artificial Sequence
  Synthetic Oligonucleotide
caattccttataagttgaggt

SEQ ID NO: 1208 - DNA, 21 bp, Artificial Sequence
  Synthetic Oligonucleotide
caattggacgtaagttgtctt

SEQ ID NO: 1209 - DNA, 22 bp, Artificial Sequence
  Synthetic Oligonucleotide
gaatttctacttcccagtagat

SEQ ID NO: 1210 - DNA, 21 bp, Artificial Sequence
  Synthetic Oligonucleotide
caatttctactgaccgtagat

SEQ ID NO: 1211 - DNA, 21 bp, Artificial Sequence
  Synthetic Oligonucleotide
caatttctactcggagtagat

SEQ ID NO: 1212 - DNA, 20 bp, Artificial Sequence
  Synthetic Oligonucleotide
aaatttctactgcggtagat

SEQ ID NO: 1213 - DNA, 22 bp, Artificial Sequence
  Synthetic Oligonucleotide
caatttctcctattctggagat

SEQ ID NO: 1214 - DNA, 22 bp, Artificial Sequence
  Synthetic Oligonucleotide
caatttctactccgtggtagat

SEQ ID NO: 1215 - DNA, 21 bp, Artificial Sequence
  Synthetic Oligonucleotide
gaatttctacaatccgtagat

SEQ ID NO: 1216 - DNA, 20 bp, Artificial Sequence
  Synthetic Oligonucleotide
caatttctacttctgtagat

SEQ ID NO: 1217 - DNA, 22 bp, Artificial Sequence
  Synthetic Oligonucleotide
gaatttctactctgcggtagat

SEQ ID NO: 1218 - DNA, 21 bp, Artificial Sequence
  Synthetic Oligonucleotide
gaatttctcctccgtggagat

SEQ ID NO: 1219 - DNA, 21 bp, Artificial Sequence
  Synthetic Oligonucleotide
gaatttctcctatggggagat

SEQ ID NO: 1220 - DNA, 21 bp, Artificial Sequence
  Synthetic Oligonucleotide
caattagttgtaagtcagttt

SEQ ID NO: 1221 - DNA, 22 bp, Artificial Sequence
  Synthetic Oligonucleotide
gaatttctactccgatgtagat

SEQ ID NO: 1222 - DNA, 22 bp, Artificial Sequence
  Synthetic Oligonucleotide
caatttctactctgcggtagat

SEQ ID NO: 1223 - DNA, 21 bp, Artificial Sequence
  Synthetic Oligonucleotide
caatttctacacgctgtagat

SEQ ID NO: 1224 - DNA, 21 bp, Artificial Sequence
  Synthetic Oligonucleotide
gaatttctacctcccgtagat

SEQ ID NO: 1225 - DNA, 22 bp, Artificial Sequence
  Synthetic Oligonucleotide
aaatttctactcgagggtagat

SEQ ID NO: 1226 - DNA, 21 bp, Artificial Sequence
  Synthetic Oligonucleotide
gaattggctttaagtaggtct

SEQ ID NO: 1227 - DNA, 20 bp, Artificial Sequence
  Synthetic Oligonucleotide
caattgctagtcttttggtt

SEQ ID NO: 1228 - DNA, 22 bp, Artificial Sequence
  Synthetic Oligonucleotide
gaatttctactgcggagtagat

SEQ ID NO: 1229 - DNA, 22 bp, Artificial Sequence
  Synthetic Oligonucleotide
caatttctactcatctgtagat

SEQ ID NO: 1230 - DNA, 20 bp, Artificial Sequence
  Synthetic Oligonucleotide
caatttctactgcagtagat

SEQ ID NO: 1231 - DNA, 22 bp, Artificial Sequence
  Synthetic Oligonucleotide
gaatttctcctatttcggagat

SEQ ID NO: 1232 - DNA, 22 bp, Artificial Sequence
  Synthetic Oligonucleotide
gaatttctactgcggggtagat

SEQ ID NO: 1233 - DNA, 22 bp, Artificial Sequence
  Synthetic Oligonucleotide
caatttctactaaagggtagat

SEQ ID NO: 1234 - DNA, 22 bp, Artificial Sequence
  Synthetic Oligonucleotide
caatttctactctccagtagat

SEQ ID NO: 1235 - DNA, 22 bp, Artificial Sequence
  Synthetic Oligonucleotide
gaatttctaccatttcgtagat

SEQ ID NO: 1236 - DNA, 21 bp, Artificial Sequence
  Synthetic Oligonucleotide
gaatttctcctgcgaggagat

SEQ ID NO: 1237 - DNA, 20 bp, Artificial Sequence
  Synthetic Oligonucleotide
caatttctactaccgtagat

SEQ ID NO: 1238 - DNA, 22 bp, Artificial Sequence
  Synthetic Oligonucleotide
caatttctacttccatgtagat

SEQ ID NO: 1239 - DNA, 22 bp, Artificial Sequence
  Synthetic Oligonucleotide
caatttctacttccccgtagat

SEQ ID NO: 1240 - DNA, 21 bp, Artificial Sequence
  Synthetic Oligonucleotide
caattgactgtaagttagttt

SEQ ID NO: 1241 - DNA, 22 bp, Artificial Sequence
  Synthetic Oligonucleotide
aaatttctacggaaatgtagat

SEQ ID NO: 1242 - DNA, 22 bp, Artificial Sequence
  Synthetic Oligonucleotide
caatttctacaacatggtagat

SEQ ID NO: 1243 - DNA, 20 bp, Artificial Sequence
  Synthetic Oligonucleotide
caatttctactggagtagat

SEQ ID NO: 1244 - DNA, 22 bp, Artificial Sequence
  Synthetic Oligonucleotide
gaatttctcctacgctggagat

SEQ ID NO: 1245 - DNA, 21 bp, Artificial Sequence
  Synthetic Oligonucleotide
gaatttctactacaagtagat

SEQ ID NO: 1246 - DNA, 21 bp, Artificial Sequence
  Synthetic Oligonucleotide
caatttctactctaggtagat

SEQ ID NO: 1247 - DNA, 22 bp, Artificial Sequence
  Synthetic Oligonucleotide
gaatttctactcataggtagat

SEQ ID NO: 1248 - DNA, 22 bp, Artificial Sequence
  Synthetic Oligonucleotide
gaatttctactgataggtagat

SEQ ID NO: 1249 - DNA, 21 bp, Artificial Sequence
  Synthetic Oligonucleotide
caatttctacctcaggtagat

SEQ ID NO: 1250 - DNA, 22 bp, Artificial Sequence
  Synthetic Oligonucleotide
caatttctactctagcgtagat

SEQ ID NO: 1251 - DNA, 21 bp, Artificial Sequence
  Synthetic Oligonucleotide
caatttctactcgaagtagat

SEQ ID NO: 1252 - DNA, 22 bp, Artificial Sequence
  Synthetic Oligonucleotide
aaatttctcctactgcggagat

SEQ ID NO: 1253 - DNA, 22 bp, Artificial Sequence
  Synthetic Oligonucleotide
caatttctactcttaagtagat

SEQ ID NO: 1254 - DNA, 22 bp, Artificial Sequence
  Synthetic Oligonucleotide
caatttctactttagggtagat

SEQ ID NO: 1255 - DNA, 22 bp, Artificial Sequence
  Synthetic Oligonucleotide
caatttctactccacggtagat

SEQ ID NO: 1256 - DNA, 21 bp, Artificial Sequence
  Synthetic Oligonucleotide
caatttctactggttgtagat

SEQ ID NO: 1257 - DNA, 22 bp, Artificial Sequence
  Synthetic Oligonucleotide
caatttctactgacatgtagat

SEQ ID NO: 1258 - DNA, 21 bp, Artificial Sequence
  Synthetic Oligonucleotide
caatttctactttgagtagat

SEQ ID NO: 1259 - DNA, 20 bp, Artificial Sequence
  Synthetic Oligonucleotide
caatttctacttgagtagat

SEQ ID NO: 1260 - DNA, 21 bp, Artificial Sequence
  Synthetic Oligonucleotide
caatttctcctttgaggagat

SEQ ID NO: 1261 - DNA, 22 bp, Artificial Sequence
  Synthetic Oligonucleotide
caatttctactccgttgtagat

SEQ ID NO: 1262 - DNA, 21 bp, Artificial Sequence
  Synthetic Oligonucleotide
gaatttggtgtaagttgccat

SEQ ID NO: 1263 - DNA, 21 bp, Artificial Sequence
  Synthetic Oligonucleotide
caatttctactagaggtagat

SEQ ID NO: 1264 - DNA, 22 bp, Artificial Sequence
  Synthetic Oligonucleotide
caatttctactgataggtagat

SEQ ID NO: 1265 - DNA, 22 bp, Artificial Sequence
  Synthetic Oligonucleotide
caatttctacttcatcgtagat

SEQ ID NO: 1266 - DNA, 20 bp, Artificial Sequence
  Synthetic Oligonucleotide
gaatttctactggtgtagat

SEQ ID NO: 1267 - DNA, 22 bp, Artificial Sequence
  Synthetic Oligonucleotide
caatttctactgccgggtagat

SEQ ID NO: 1268 - DNA, 22 bp, Artificial Sequence
  Synthetic Oligonucleotide
gaatttctacgcattagtagat

SEQ ID NO: 1269 - DNA, 22 bp, Artificial Sequence
  Synthetic Oligonucleotide
caatttctcccagccgggagat

SEQ ID NO: 1270 - DNA, 22 bp, Artificial Sequence
  Synthetic Oligonucleotide
caatttctactcaatggtagat

SEQ ID NO: 1271 - DNA, 22 bp, Artificial Sequence
  Synthetic Oligonucleotide
caatttctcctaattcggagat

SEQ ID NO: 1272 - DNA, 22 bp, Artificial Sequence
  Synthetic Oligonucleotide
caatttctactagtatgtagat

SEQ ID NO: 1273 - DNA, 22 bp, Artificial Sequence
  Synthetic Oligonucleotide
gaatttctactcgcgcgtagat

SEQ ID NO: 1274 - DNA, 21 bp, Artificial Sequence
  Synthetic Oligonucleotide
caatttctacagtaagtagat

SEQ ID NO: 1275 - DNA, 22 bp, Artificial Sequence
  Synthetic Oligonucleotide
caatttctactgagctgtagat

SEQ ID NO: 1276 - DNA, 21 bp, Artificial Sequence
  Synthetic Oligonucleotide
aaatttgacctaagtggtcgt

SEQ ID NO: 1277 - DNA, 21 bp, Artificial Sequence
  Synthetic Oligonucleotide
caattgtacttaagtagtatt

SEQ ID NO: 1278 - DNA, 22 bp, Artificial Sequence
  Synthetic Oligonucleotide
caatttctactagcccgtagat

SEQ ID NO: 1279 - DNA, 22 bp, Artificial Sequence
  Synthetic Oligonucleotide
caatttctactcgctcgtagat

SEQ ID NO: 1280 - DNA, 21 bp, Artificial Sequence
  Synthetic Oligonucleotide
gaatttctactggatgtagat

SEQ ID NO: 1281 - DNA, 22 bp, Artificial Sequence
  Synthetic Oligonucleotide
caatttctactcggtggtagat

SEQ ID NO: 1282 - DNA, 20 bp, Artificial Sequence
  Synthetic Oligonucleotide
gaatttgtcgtcttcgacgt

SEQ ID NO: 1283 - DNA, 22 bp, Artificial Sequence
  Synthetic Oligonucleotide
gaatttctactcccacgtagat

SEQ ID NO: 1284 - DNA, 22 bp, Artificial Sequence
  Synthetic Oligonucleotide
gaatttctcctagcgcggagat

SEQ ID NO: 1285 - DNA, 22 bp, Artificial Sequence
  Synthetic Oligonucleotide
gaatttctactggtaggtagat

SEQ ID NO: 1286 - DNA, 22 bp, Artificial Sequence
  Synthetic Oligonucleotide
gaatttctactagtgcgtagat

SEQ ID NO: 1287 - DNA, 22 bp, Artificial Sequence
  Synthetic Oligonucleotide
caatttctactcctcagtagat

SEQ ID NO: 1288 - DNA, 21 bp, Artificial Sequence
  Synthetic Oligonucleotide
gaatttctactccatgtagat

SEQ ID NO: 1289 - DNA, 21 bp, Artificial Sequence
  Synthetic Oligonucleotide
gaattgcctataagttaggct

SEQ ID NO: 1290 - DNA, 22 bp, Artificial Sequence
  Synthetic Oligonucleotide
caatttctactgggctgtagat

SEQ ID NO: 1291 - DNA, 20 bp, Artificial Sequence
  Synthetic Oligonucleotide
caattagtgatcttttgttt

SEQ ID NO: 1292 - DNA, 21 bp, Artificial Sequence
  Synthetic Oligonucleotide
caatttctcctatgcggagat

SEQ ID NO: 1293 - DNA, 20 bp, Artificial Sequence
  Synthetic Oligonucleotide
caattttaggtcttcttagt

SEQ ID NO: 1294 - DNA, 22 bp, Artificial Sequence
  Synthetic Oligonucleotide
caatttctactggtgtgtagat

SEQ ID NO: 1295 - DNA, 22 bp, Artificial Sequence
  Synthetic Oligonucleotide
caatttctactcctcggtagat

SEQ ID NO: 1296 - DNA, 22 bp, Artificial Sequence
  Synthetic Oligonucleotide
caatttctactcctacgtagat

SEQ ID NO: 1297 - DNA, 22 bp, Artificial Sequence
  Synthetic Oligonucleotide
caatttctactttgtcgtagat

SEQ ID NO: 1298 - DNA, 22 bp, Artificial Sequence
  Synthetic Oligonucleotide
gaatttctacttggtcgtagat

SEQ ID NO: 1299 - DNA, 22 bp, Artificial Sequence
  Synthetic Oligonucleotide
gaatttctccgtaagaggagat

SEQ ID NO: 1300 - DNA, 20 bp, Artificial Sequence
  Synthetic Oligonucleotide
caattgtgcttcttagtact

SEQ ID NO: 1301 - DNA, 22 bp, Artificial Sequence
  Synthetic Oligonucleotide
aaatttctactctggcgtagat

SEQ ID NO: 1302 - DNA, 22 bp, Artificial Sequence
  Synthetic Oligonucleotide
caatttctcctagtgcggagat

SEQ ID NO: 1303 - DNA, 22 bp, Artificial Sequence
  Synthetic Oligonucleotide
gaatttctacttaaccgtagat

SEQ ID NO: 1304 - DNA, 22 bp, Artificial Sequence
  Synthetic Oligonucleotide
caatttctactgacgtgtagat

SEQ ID NO: 1305 - DNA, 20 bp, Artificial Sequence
  Synthetic Oligonucleotide
caattgggcgtcttcgtcct

SEQ ID NO: 1306 - DNA, 21 bp, Artificial Sequence
  Synthetic Oligonucleotide
caatttctactcgttgtagat

SEQ ID NO: 1307 - DNA, 21 bp, Artificial Sequence
  Synthetic Oligonucleotide
caatttctaccattagtagat

SEQ ID NO: 1308 - DNA, 21 bp, Artificial Sequence
  Synthetic Oligonucleotide
caatttctaccacttgtagat

SEQ ID NO: 1309 - DNA, 21 bp, Artificial Sequence
  Synthetic Oligonucleotide
caatttctactagcggtagat

SEQ ID NO: 1310 - DNA, 22 bp, Artificial Sequence
  Synthetic Oligonucleotide
caatttctactataacgtagat

SEQ ID NO: 1311 - DNA, 20 bp, Artificial Sequence
  Synthetic Oligonucleotide
caattccgcttcttagtggt

SEQ ID NO: 1312 - DNA, 22 bp, Artificial Sequence
  Synthetic Oligonucleotide
caatttctactcggacgtagat

SEQ ID NO: 1313 - DNA, 22 bp, Artificial Sequence
  Synthetic Oligonucleotide
caatttctactatgaagtagat

SEQ ID NO: 1314 - DNA, 20 bp, Artificial Sequence
  Synthetic Oligonucleotide
caatttaagctcttgtttgt

SEQ ID NO: 1315 - DNA, 22 bp, Artificial Sequence
  Synthetic Oligonucleotide
aaatttctcccttgcgggagat

SEQ ID NO: 1316 - DNA, 21 bp, Artificial Sequence
  Synthetic Oligonucleotide
gaatttctcctcctaggagat

SEQ ID NO: 1317 - DNA, 22 bp, Artificial Sequence
  Synthetic Oligonucleotide
gaatttctacagtggcgtagat

SEQ ID NO: 1318 - DNA, 22 bp, Artificial Sequence
  Synthetic Oligonucleotide
caatttctactccagagtagat

SEQ ID NO: 1319 - DNA, 22 bp, Artificial Sequence
  Synthetic Oligonucleotide
gaatttctactcggtggtagat

SEQ ID NO: 1320 - DNA, 22 bp, Artificial Sequence
  Synthetic Oligonucleotide
caatttctacttcgttgtagat

SEQ ID NO: 1321 - DNA, 22 bp, Artificial Sequence
  Synthetic Oligonucleotide
caatttctactaaccagtagat

SEQ ID NO: 1322 - DNA, 22 bp, Artificial Sequence
  Synthetic Oligonucleotide
caatttctactccctggtagat

SEQ ID NO: 1323 - DNA, 21 bp, Artificial Sequence
  Synthetic Oligonucleotide
caatttctcctgaagggagat

SEQ ID NO: 1324 - DNA, 22 bp, Artificial Sequence
  Synthetic Oligonucleotide
caatttctactacacggtagat

SEQ ID NO: 1325 - DNA, 22 bp, Artificial Sequence
  Synthetic Oligonucleotide
caatttctactcctctgtagat

SEQ ID NO: 1326 - DNA, 22 bp, Artificial Sequence
  Synthetic Oligonucleotide
aaatttctaccgcaatgtagat

SEQ ID NO: 1327 - DNA, 22 bp, Artificial Sequence
  Synthetic Oligonucleotide
caatttctacttcactgtagat

SEQ ID NO: 1328 - DNA, 21 bp, Artificial Sequence
  Synthetic Oligonucleotide
caatttctacttgccgtagat

SEQ ID NO: 1329 - DNA, 22 bp, Artificial Sequence
  Synthetic Oligonucleotide
caatttctactgtattgtagat

SEQ ID NO: 1330 - DNA, 21 bp, Artificial Sequence
  Synthetic Oligonucleotide
caatttctactcagtgtagat

SEQ ID NO: 1331 - DNA, 22 bp, Artificial Sequence
  Synthetic Oligonucleotide
caatttctactaattagtagat

SEQ ID NO: 1332 - DNA, 22 bp, Artificial Sequence
  Synthetic Oligonucleotide
caatttctacttagtcgtagat

SEQ ID NO: 1333 - DNA, 20 bp, Artificial Sequence
  Synthetic Oligonucleotide
gaattgctcatctttgggct

SEQ ID NO: 1334 - DNA, 22 bp, Artificial Sequence
  Synthetic Oligonucleotide
caatttctacataggagtagat

SEQ ID NO: 1335 - DNA, 22 bp, Artificial Sequence
  Synthetic Oligonucleotide
gaatttctacaatagggtagat

SEQ ID NO: 1336 - DNA, 22 bp, Artificial Sequence
  Synthetic Oligonucleotide
caatttctactactgtgtagat

SEQ ID NO: 1337 - DNA, 22 bp, Artificial Sequence
  Synthetic Oligonucleotide
gaatttctactaagcggtagat

SEQ ID NO: 1338 - DNA, 21 bp, Artificial Sequence
  Synthetic Oligonucleotide
caatttctactcacagtagat

SEQ ID NO: 1339 - DNA, 22 bp, Artificial Sequence
  Synthetic Oligonucleotide
aaatttctactttgaggtagat

SEQ ID NO: 1340 - DNA, 21 bp, Artificial Sequence
  Synthetic Oligonucleotide
caatttctcctactgggagat

SEQ ID NO: 1341 - DNA, 21 bp, Artificial Sequence
  Synthetic Oligonucleotide
gaatttctactgaccgtagat

SEQ ID NO: 1342 - DNA, 21 bp, Artificial Sequence
  Synthetic Oligonucleotide
caatttctactttaagtagat

SEQ ID NO: 1343 - DNA, 22 bp, Artificial Sequence
  Synthetic Oligonucleotide
caatttctactattaggtagat

SEQ ID NO: 1344 - DNA, 20 bp, Artificial Sequence
  Synthetic Oligonucleotide
caatttctactaaagtagat

SEQ ID NO: 1345 - DNA, 20 bp, Artificial Sequence
  Synthetic Oligonucleotide
caatttctactttggtagat

SEQ ID NO: 1346 - DNA, 22 bp, Artificial Sequence
  Synthetic Oligonucleotide
caatttctactaaaaggtagat

SEQ ID NO: 1347 - DNA, 21 bp, Artificial Sequence
  Synthetic Oligonucleotide
aaattgcgcgtaagttgtgtt

SEQ ID NO: 1348 - DNA, 22 bp, Artificial Sequence
  Synthetic Oligonucleotide
caatttctacttgtcagtagat

SEQ ID NO: 1349 - DNA, 22 bp, Artificial Sequence
  Synthetic Oligonucleotide
caatttctactgcctcgtagat

SEQ ID NO: 1350 - DNA, 22 bp, Artificial Sequence
  Synthetic Oligonucleotide
caatttctactaacaggtagat

SEQ ID NO: 1351 - DNA, 22 bp, Artificial Sequence
  Synthetic Oligonucleotide
caatttctactaggtcgtagat

SEQ ID NO: 1352 - DNA, 22 bp, Artificial Sequence
  Synthetic Oligonucleotide
caatttctacttctcggtagat

SEQ ID NO: 1353 - DNA, 22 bp, Artificial Sequence
  Synthetic Oligonucleotide
caatttctcctaagggggagat

SEQ ID NO: 1354 - DNA, 22 bp, Artificial Sequence
  Synthetic Oligonucleotide
gaatttctaccgatcggtagat

SEQ ID NO: 1355 - DNA, 21 bp, Artificial Sequence
  Synthetic Oligonucleotide
caatttctcctaggtggagat

SEQ ID NO: 1356 - DNA, 22 bp, Artificial Sequence
  Synthetic Oligonucleotide
caatttctactctagagtagat

SEQ ID NO: 1357 - DNA, 20 bp, Artificial Sequence
  Synthetic Oligonucleotide
gaatttctacatacgtagat

SEQ ID NO: 1358 - DNA, 22 bp, Artificial Sequence
  Synthetic Oligonucleotide
caatttctactcccaggtagat

SEQ ID NO: 1359 - DNA, 21 bp, Artificial Sequence
  Synthetic Oligonucleotide
caatttctactgcctgtagat

SEQ ID NO: 1360 - DNA, 22 bp, Artificial Sequence
  Synthetic Oligonucleotide
gaatttctcctacactggagat

SEQ ID NO: 1361 - DNA, 20 bp, Artificial Sequence
  Synthetic Oligonucleotide
caattctgtttcttaacagt

SEQ ID NO: 1362 - DNA, 21 bp, Artificial Sequence
  Synthetic Oligonucleotide
caatttctacttcgagtagat

SEQ ID NO: 1363 - DNA, 22 bp, Artificial Sequence
  Synthetic Oligonucleotide
caatttctcctacctcggagat

SEQ ID NO: 1364 - DNA, 21 bp, Artificial Sequence
  Synthetic Oligonucleotide
caattggtgctaagtgtgctt

SEQ ID NO: 1365 - DNA, 20 bp, Artificial Sequence
  Synthetic Oligonucleotide
caatttctcccgaaggagat

SEQ ID NO: 1366 - DNA, 22 bp, Artificial Sequence
  Synthetic Oligonucleotide
caatttctactgatgggtagat

SEQ ID NO: 1367 - DNA, 22 bp, Artificial Sequence
  Synthetic Oligonucleotide
caatttctactcgtacgtagat

SEQ ID NO: 1368 - DNA, 22 bp, Artificial Sequence
  Synthetic Oligonucleotide
aaatttctaccaacatgtagat

SEQ ID NO: 1369 - DNA, 22 bp, Artificial Sequence
  Synthetic Oligonucleotide
caatttctactgagtcgtagat

SEQ ID NO: 1370 - DNA, 22 bp, Artificial Sequence
  Synthetic Oligonucleotide
caatttctactacatcgtagat

SEQ ID NO: 1371 - DNA, 22 bp, Artificial Sequence
  Synthetic Oligonucleotide
caatttctacttccgagtagat

SEQ ID NO: 1372 - DNA, 20 bp, Artificial Sequence
  Synthetic Oligonucleotide
gaatttctactcccgtagat

SEQ ID NO: 1373 - DNA, 21 bp, Artificial Sequence
  Synthetic Oligonucleotide
caatttctaccagtggtagat

SEQ ID NO: 1374 - DNA, 22 bp, Artificial Sequence
  Synthetic Oligonucleotide
caatttctactgcgccgtagat

SEQ ID NO: 1375 - DNA, 20 bp, Artificial Sequence
  Synthetic Oligonucleotide
gaatttctccttcaggagat

SEQ ID NO: 1376 - DNA, 21 bp, Artificial Sequence
  Synthetic Oligonucleotide
caatttctactttatgtagat

SEQ ID NO: 1377 - DNA, 20 bp, Artificial Sequence
  Synthetic Oligonucleotide
gaatttctactccggtagat

SEQ ID NO: 1378 - DNA, 22 bp, Artificial Sequence
  Synthetic Oligonucleotide
gaatttctactcgccggtagat

SEQ ID NO: 1379 - DNA, 21 bp, Artificial Sequence
  Synthetic Oligonucleotide
caatttctactgggagtagat

SEQ ID NO: 1380 - DNA, 22 bp, Artificial Sequence
  Synthetic Oligonucleotide
gaatttctacactcgagtagat

SEQ ID NO: 1381 - DNA, 20 bp, Artificial Sequence
  Synthetic Oligonucleotide
caattggcaatcttttgctt

SEQ ID NO: 1382 - DNA, 22 bp, Artificial Sequence
  Synthetic Oligonucleotide
caatttctactaagttgtagat

SEQ ID NO: 1383 - DNA, 22 bp, Artificial Sequence
  Synthetic Oligonucleotide
caatttctccttctgtggagat

SEQ ID NO: 1384 - DNA, 21 bp, Artificial Sequence
  Synthetic Oligonucleotide
caatttctactctacgtagat

SEQ ID NO: 1385 - DNA, 22 bp, Artificial Sequence
  Synthetic Oligonucleotide
gaatttctactgcagcgtagat

SEQ ID NO: 1386 - DNA, 21 bp, Artificial Sequence
  Synthetic Oligonucleotide
aaatttctaccacgcgtagat

SEQ ID NO: 1387 - DNA, 22 bp, Artificial Sequence
  Synthetic Oligonucleotide
aaatttctaccgccttgtagat

SEQ ID NO: 1388 - DNA, 22 bp, Artificial Sequence
  Synthetic Oligonucleotide
gaatttctacgtccgtgtagat

SEQ ID NO: 1389 - DNA, 21 bp, Artificial Sequence
  Synthetic Oligonucleotide
gaatttctactcttggtagat

SEQ ID NO: 1390 - DNA, 21 bp, Artificial Sequence
  Synthetic Oligonucleotide
caatttctacttacggtagat

SEQ ID NO: 1391 - DNA, 22 bp, Artificial Sequence
  Synthetic Oligonucleotide
gaatttctaccattgcgtagat

SEQ ID NO: 1392 - DNA, 22 bp, Artificial Sequence
  Synthetic Oligonucleotide
gaatttctcctaccatggagat

SEQ ID NO: 1393 - DNA, 22 bp, Artificial Sequence
  Synthetic Oligonucleotide
gaatttctactgcaacgtagat

SEQ ID NO: 1394 - DNA, 22 bp, Artificial Sequence
  Synthetic Oligonucleotide
caatttctactaaggcgtagat

SEQ ID NO: 1395 - DNA, 21 bp, Artificial Sequence
  Synthetic Oligonucleotide
caatttctcctatgtggagat

SEQ ID NO: 1396 - DNA, 22 bp, Artificial Sequence
  Synthetic Oligonucleotide
gaatttctacttcagcgtagat

SEQ ID NO: 1397 - DNA, 21 bp, Artificial Sequence
  Synthetic Oligonucleotide
caatttctacttttcgtagat

SEQ ID NO: 1398 - DNA, 21 bp, Artificial Sequence
  Synthetic Oligonucleotide
caatttcgcctaagtggcgat

SEQ ID NO: 1399 - DNA, 22 bp, Artificial Sequence
  Synthetic Oligonucleotide
caatttctacttgtatgtagat

SEQ ID NO: 1400 - DNA, 21 bp, Artificial Sequence
  Synthetic Oligonucleotide
caatttctactattcgtagat

SEQ ID NO: 1401 - DNA, 22 bp, Artificial Sequence
  Synthetic Oligonucleotide
caatttctactgagccgtagat

SEQ ID NO: 1402 - DNA, 22 bp, Artificial Sequence
  Synthetic Oligonucleotide
caatttctcctaaactggagat

SEQ ID NO: 1403 - DNA, 22 bp, Artificial Sequence
  Synthetic Oligonucleotide
caatttctccaaggcaggagat

SEQ ID NO: 1404 - DNA, 22 bp, Artificial Sequence
  Synthetic Oligonucleotide
aaatttctcctacgtaggagat

SEQ ID NO: 1405 - DNA, 21 bp, Artificial Sequence
  Synthetic Oligonucleotide
caatttctactgcgagtagat

SEQ ID NO: 1406 - DNA, 21 bp, Artificial Sequence
  Synthetic Oligonucleotide
caattcctaataagtttaggt

SEQ ID NO: 1407 - DNA, 20 bp, Artificial Sequence
  Synthetic Oligonucleotide
gaattcgtgttcttatgtgt

SEQ ID NO: 1408 - DNA, 22 bp, Artificial Sequence
  Synthetic Oligonucleotide
aaatttctacgttgctgtagat

SEQ ID NO: 1409 - DNA, 21 bp, Artificial Sequence
  Synthetic Oligonucleotide
caatttctacctctcgtagat

SEQ ID NO: 1410 - DNA, 20 bp, Artificial Sequence
  Synthetic Oligonucleotide
caattgagtttcttagttct

SEQ ID NO: 1411 - DNA, 21 bp, Artificial Sequence
  Synthetic Oligonucleotide
caatttctcctagcgggagat

SEQ ID NO: 1412 - DNA, 22 bp, Artificial Sequence
  Synthetic Oligonucleotide
caatttctactttgaggtagat

SEQ ID NO: 1413 - DNA, 22 bp, Artificial Sequence
  Synthetic Oligonucleotide
gaatttctactattgagtagat

SEQ ID NO: 1414 - DNA, 22 bp, Artificial Sequence
  Synthetic Oligonucleotide
caatttctacttcaaggtagat

SEQ ID NO: 1415 - DNA, 22 bp, Artificial Sequence
  Synthetic Oligonucleotide
caatttctactgaggagtagat

SEQ ID NO: 1416 - DNA, 22 bp, Artificial Sequence
  Synthetic Oligonucleotide
caatttctactggagggtagat

SEQ ID NO: 1417 - DNA, 22 bp, Artificial Sequence
  Synthetic Oligonucleotide
caatttctacttgggtgtagat

SEQ ID NO: 1418 - DNA, 22 bp, Artificial Sequence
  Synthetic Oligonucleotide
caatttctactgttacgtagat

SEQ ID NO: 1419 - DNA, 21 bp, Artificial Sequence
  Synthetic Oligonucleotide
aaatttctacctccagtagat

SEQ ID NO: 1420 - DNA, 21 bp, Artificial Sequence
  Synthetic Oligonucleotide
caattgggactaagtgttttt

SEQ ID NO: 1421 - DNA, 21 bp, Artificial Sequence
  Synthetic Oligonucleotide
caatttctccttcgaggagat

SEQ ID NO: 1422 - DNA, 22 bp, Artificial Sequence
  Synthetic Oligonucleotide
caatttctactggcctgtagat

SEQ ID NO: 1423 - DNA, 22 bp, Artificial Sequence
  Synthetic Oligonucleotide
caatttctacgattcagtagat

SEQ ID NO: 1424 - DNA, 21 bp, Artificial Sequence
  Synthetic Oligonucleotide
caatttctacaatgcgtagat

SEQ ID NO: 1425 - DNA, 20 bp, Artificial Sequence
  Synthetic Oligonucleotide
caatttcgcatctttgcggt

SEQ ID NO: 1426 - DNA, 22 bp, Artificial Sequence
  Synthetic Oligonucleotide
caatttctccgtcgtgggagat

SEQ ID NO: 1427 - DNA, 22 bp, Artificial Sequence
  Synthetic Oligonucleotide
caatttctactttccagtagat

SEQ ID NO: 1428 - DNA, 22 bp, Artificial Sequence
  Synthetic Oligonucleotide
caatttctactgatccgtagat

SEQ ID NO: 1429 - DNA, 22 bp, Artificial Sequence
  Synthetic Oligonucleotide
caatttctactacggagtagat

SEQ ID NO: 1430 - DNA, 21 bp, Artificial Sequence
  Synthetic Oligonucleotide
aaatttctaccgcttgtagat

SEQ ID NO: 1431 - DNA, 22 bp, Artificial Sequence
  Synthetic Oligonucleotide
gaatttctactgtgaggtagat

SEQ ID NO: 1432 - DNA, 22 bp, Artificial Sequence
  Synthetic Oligonucleotide
caatttctccttttgtggagat

SEQ ID NO: 1433 - DNA, 20 bp, Artificial Sequence
  Synthetic Oligonucleotide
gaatttctactacggtagat

SEQ ID NO: 1434 - DNA, 22 bp, Artificial Sequence
  Synthetic Oligonucleotide
gaatttctactgtgtcgtagat

SEQ ID NO: 1435 - DNA, 22 bp, Artificial Sequence
  Synthetic Oligonucleotide
caatttctcctagttcggagat

SEQ ID NO: 1436 - DNA, 22 bp, Artificial Sequence
  Synthetic Oligonucleotide
caatttctactcctgtgtagat

SEQ ID NO: 1437 - DNA, 22 bp, Artificial Sequence
  Synthetic Oligonucleotide
gaatttctacttgaacgtagat

SEQ ID NO: 1438 - DNA, 20 bp, Artificial Sequence
  Synthetic Oligonucleotide
caattgatgatctttcatct

SEQ ID NO: 1439 - DNA, 22 bp, Artificial Sequence
  Synthetic Oligonucleotide
caatttctactggtacgtagat

SEQ ID NO: 1440 - DNA, 22 bp, Artificial Sequence
  Synthetic Oligonucleotide
aaatttctactcatccgtagat

SEQ ID NO: 1441 - DNA, 21 bp, Artificial Sequence
  Synthetic Oligonucleotide
caatttctgctaagtgcagat

SEQ ID NO: 1442 - DNA, 20 bp, Artificial Sequence
  Synthetic Oligonucleotide
caattcaggttcttatttgt

SEQ ID NO: 1443 - DNA, 22 bp, Artificial Sequence
  Synthetic Oligonucleotide
gaatttctactacgcagtagat

SEQ ID NO: 1444 - DNA, 20 bp, Artificial Sequence
  Synthetic Oligonucleotide
gaattgcgtttcttggcgct

SEQ ID NO: 1445 - DNA, 22 bp, Artificial Sequence
  Synthetic Oligonucleotide
caatttctcctattttggagat

SEQ ID NO: 1446 - DNA, 22 bp, Artificial Sequence
  Synthetic Oligonucleotide
gaatttctacgcacaggtagat

SEQ ID NO: 1447 - DNA, 22 bp, Artificial Sequence
  Synthetic Oligonucleotide
caatttctactgaagcgtagat

SEQ ID NO: 1448 - DNA, 22 bp, Artificial Sequence
  Synthetic Oligonucleotide
gaatttctactaacacgtagat

SEQ ID NO: 1449 - DNA, 20 bp, Artificial Sequence
  Synthetic Oligonucleotide
caattaggtatctttacctt

SEQ ID NO: 1450 - DNA, 21 bp, Artificial Sequence
  Synthetic Oligonucleotide
caattgggtgtaagttgcctt

SEQ ID NO: 1451 - DNA, 22 bp, Artificial Sequence
  Synthetic Oligonucleotide
caatttctactgcagggtagat

SEQ ID NO: 1452 - DNA, 22 bp, Artificial Sequence
  Synthetic Oligonucleotide
caatttctactcgcgcgtagat

SEQ ID NO: 1453 - DNA, 22 bp, Artificial Sequence
  Synthetic Oligonucleotide
gaatttctactggatggtagat

SEQ ID NO: 1454 - DNA, 21 bp, Artificial Sequence
  Synthetic Oligonucleotide
caattccatgtaagttatggt

SEQ ID NO: 1455 - DNA, 20 bp, Artificial Sequence
  Synthetic Oligonucleotide
caatttctactcctgtagat

SEQ ID NO: 1456 - DNA, 22 bp, Artificial Sequence
  Synthetic Oligonucleotide
caatttctactattgtgtagat

SEQ ID NO: 1457 - DNA, 21 bp, Artificial Sequence
  Synthetic Oligonucleotide
caatttcgggtaagtttcggt

SEQ ID NO: 1458 - DNA, 22 bp, Artificial Sequence
  Synthetic Oligonucleotide
caatttctacttcagtgtagat

SEQ ID NO: 1459 - DNA, 21 bp, Artificial Sequence
  Synthetic Oligonucleotide
caatttctactctgggtagat

SEQ ID NO: 1460 - DNA, 22 bp, Artificial Sequence
  Synthetic Oligonucleotide
caatttctactactcagtagat

SEQ ID NO: 1461 - DNA, 21 bp, Artificial Sequence
  Synthetic Oligonucleotide
caatttctacctcatgtagat

SEQ ID NO: 1462 - DNA, 22 bp, Artificial Sequence
  Synthetic Oligonucleotide
caatttctactggtgagtagat

SEQ ID NO: 1463 - DNA, 22 bp, Artificial Sequence
  Synthetic Oligonucleotide
caatttctactgtctggtagat

SEQ ID NO: 1464 - DNA, 21 bp, Artificial Sequence
  Synthetic Oligonucleotide
caatttctactctgtgtagat

SEQ ID NO: 1465 - DNA, 22 bp, Artificial Sequence
  Synthetic Oligonucleotide
caatttctactcagttgtagat

SEQ ID NO: 1466 - DNA, 20 bp, Artificial Sequence
  Synthetic Oligonucleotide
caatttccgttcttgcggat

SEQ ID NO: 1467 - DNA, 22 bp, Artificial Sequence
  Synthetic Oligonucleotide
caatttctactgtagcgtagat

SEQ ID NO: 1468 - DNA, 21 bp, Artificial Sequence
  Synthetic Oligonucleotide
aaatttctactctacgtagat

SEQ ID NO: 1469 - DNA, 21 bp, Artificial Sequence
  Synthetic Oligonucleotide
gaatttctcctatatggagat

SEQ ID NO: 1470 - DNA, 22 bp, Artificial Sequence
  Synthetic Oligonucleotide
caatttctactggcgggtagat

SEQ ID NO: 1471 - DNA, 22 bp, Artificial Sequence
  Synthetic Oligonucleotide
aaatttctactcacctgtagat

SEQ ID NO: 1472 - DNA, 22 bp, Artificial Sequence
  Synthetic Oligonucleotide
caatttctactttcgtgtagat

SEQ ID NO: 1473 - DNA, 22 bp, Artificial Sequence
  Synthetic Oligonucleotide
caatttctactacaaggtagat

SEQ ID NO: 1474 - DNA, 20 bp, Artificial Sequence
  Synthetic Oligonucleotide
caattacgtgtctttgtgtt

SEQ ID NO: 1475 - DNA, 22 bp, Artificial Sequence
  Synthetic Oligonucleotide
gaatttctactccaacgtagat

SEQ ID NO: 1476 - DNA, 22 bp, Artificial Sequence
  Synthetic Oligonucleotide
gaatttctactatgaggtagat

SEQ ID NO: 1477 - DNA, 21 bp, Artificial Sequence
  Synthetic Oligonucleotide
gaatttctcctacgaggagat

SEQ ID NO: 1478 - DNA, 20 bp, Artificial Sequence
  Synthetic Oligonucleotide
caattgagtttcttgattct

SEQ ID NO: 1479 - DNA, 20 bp, Artificial Sequence
  Synthetic Oligonucleotide
caatttctactctggtagat

SEQ ID NO: 1480 - DNA, 22 bp, Artificial Sequence
  Synthetic Oligonucleotide
caatttctacaaccgcgtagat

SEQ ID NO: 1481 - DNA, 21 bp, Artificial Sequence
  Synthetic Oligonucleotide
gaatttctacttgtcgtagat

SEQ ID NO: 1482 - DNA, 21 bp, Artificial Sequence
  Synthetic Oligonucleotide
caattgattataagttagtct

SEQ ID NO: 1483 - DNA, 22 bp, Artificial Sequence
  Synthetic Oligonucleotide
caatttctactctgacgtagat

SEQ ID NO: 1484 - DNA, 22 bp, Artificial Sequence
  Synthetic Oligonucleotide
caatttctactgattcgtagat

SEQ ID NO: 1485 - DNA, 22 bp, Artificial Sequence
  Synthetic Oligonucleotide
caatttctactcgttagtagat

SEQ ID NO: 1486 - DNA, 21 bp, Artificial Sequence
  Synthetic Oligonucleotide
caattcggattaagtgtccgt

SEQ ID NO: 1487 - DNA, 20 bp, Artificial Sequence
  Synthetic Oligonucleotide
aaattatgtgtcttcacgtt

SEQ ID NO: 1488 - DNA, 22 bp, Artificial Sequence
  Synthetic Oligonucleotide
gaatttctactgtccggtagat

SEQ ID NO: 1489 - DNA, 22 bp, Artificial Sequence
  Synthetic Oligonucleotide
gaatttctactttcccgtagat

SEQ ID NO: 1490 - DNA, 20 bp, Artificial Sequence
  Synthetic Oligonucleotide
caattgtttgtcttcgaact

SEQ ID NO: 1491 - DNA, 21 bp, Artificial Sequence
  Synthetic Oligonucleotide
aaatttctacataatgtagat

SEQ ID NO: 1492 - DNA, 21 bp, Artificial Sequence
  Synthetic Oligonucleotide
caatttctcctactcggagat

SEQ ID NO: 1493 - DNA, 21 bp, Artificial Sequence
  Synthetic Oligonucleotide
caatttctcctaaaaggagat

SEQ ID NO: 1494 - DNA, 22 bp, Artificial Sequence
  Synthetic Oligonucleotide
gaatttctactgacgcgtagat

SEQ ID NO: 1495 - DNA, 21 bp, Artificial Sequence
  Synthetic Oligonucleotide
gaatttctaccatcagtagat

SEQ ID NO: 1496 - DNA, 22 bp, Artificial Sequence
  Synthetic Oligonucleotide
gaatttctactcattcgtagat

SEQ ID NO: 1497 - DNA, 21 bp, Artificial Sequence
  Synthetic Oligonucleotide
caatttctcctaagcggagat

SEQ ID NO: 1498 - DNA, 21 bp, Artificial Sequence
  Synthetic Oligonucleotide
caatttctactcttagtagat

SEQ ID NO: 1499 - DNA, 22 bp, Artificial Sequence
  Synthetic Oligonucleotide
caatttctcctaacgtggagat

SEQ ID NO: 1500 - DNA, 22 bp, Artificial Sequence
  Synthetic Oligonucleotide
caatttctactcactcgtagat

SEQ ID NO: 1501 - DNA, 22 bp, Artificial Sequence
  Synthetic Oligonucleotide
gaatttctcctgtcctggagat

SEQ ID NO: 1502 - DNA, 22 bp, Artificial Sequence
  Synthetic Oligonucleotide
caatttctaccaacatgtagat

SEQ ID NO: 1503 - DNA, 21 bp, Artificial Sequence
  Synthetic Oligonucleotide
caattgtgtgtaagtcgtgct

SEQ ID NO: 1504 - DNA, 21 bp, Artificial Sequence
  Synthetic Oligonucleotide
gaatttctactcaatgtagat

SEQ ID NO: 1505 - DNA, 20 bp, Artificial Sequence
  Synthetic Oligonucleotide
caatttctactacggtagat

SEQ ID NO: 1506 - DNA, 20 bp, Artificial Sequence
  Synthetic Oligonucleotide
gaatttctactgaggtagat

SEQ ID NO: 1507 - DNA, 20 bp, Artificial Sequence
  Synthetic Oligonucleotide
gaattgggagtcttctccct

SEQ ID NO: 1508 - DNA, 22 bp, Artificial Sequence
  Synthetic Oligonucleotide
caatttctcctaggctggagat

SEQ ID NO: 1509 - DNA, 20 bp, Artificial Sequence
  Synthetic Oligonucleotide
caatttagtttcttgactgt

SEQ ID NO: 1510 - DNA, 21 bp, Artificial Sequence
  Synthetic Oligonucleotide
caatttctcctattcggagat

SEQ ID NO: 1511 - DNA, 20 bp, Artificial Sequence
  Synthetic Oligonucleotide
aaatttgacgtcttcgttgt

SEQ ID NO: 1512 - DNA, 22 bp, Artificial Sequence
  Synthetic Oligonucleotide
caatttctcctattggggagat

SEQ ID NO: 1513 - DNA, 22 bp, Artificial Sequence
  Synthetic Oligonucleotide
caatttctacttgactgtagat

SEQ ID NO: 1514 - DNA, 22 bp, Artificial Sequence
  Synthetic Oligonucleotide
gaatttctactcgttagtagat

SEQ ID NO: 1515 - DNA, 22 bp, Artificial Sequence
  Synthetic Oligonucleotide
caatttctactttacggtagat

SEQ ID NO: 1516 - DNA, 21 bp, Artificial Sequence
  Synthetic Oligonucleotide
caattgtgtgtaagtcacact

SEQ ID NO: 1517 - DNA, 22 bp, Artificial Sequence
  Synthetic Oligonucleotide
caatttctactttcgggtagat

SEQ ID NO: 1518 - DNA, 22 bp, Artificial Sequence
  Synthetic Oligonucleotide
caatttctactagctcgtagat

SEQ ID NO: 1519 - DNA, 21 bp, Artificial Sequence
  Synthetic Oligonucleotide
caatttctacttactgtagat

SEQ ID NO: 1520 - DNA, 21 bp, Artificial Sequence
  Synthetic Oligonucleotide
caatttctactcgctgtagat

SEQ ID NO: 1521 - DNA, 20 bp, Artificial Sequence
  Synthetic Oligonucleotide
caattggatctcttgatctt

SEQ ID NO: 1522 - DNA, 22 bp, Artificial Sequence
  Synthetic Oligonucleotide
caatttctacggaagtgtagat

SEQ ID NO: 1523 - DNA, 22 bp, Artificial Sequence
  Synthetic Oligonucleotide
aaatttctcctattggggagat

SEQ ID NO: 1524 - DNA, 22 bp, Artificial Sequence
  Synthetic Oligonucleotide
caatttctactcagcagtagat

SEQ ID NO: 1525 - DNA, 21 bp, Artificial Sequence
  Synthetic Oligonucleotide
caatttctactcatagtagat

SEQ ID NO: 1526 - DNA, 22 bp, Artificial Sequence
  Synthetic Oligonucleotide
caatttctacagacctgtagat

SEQ ID NO: 1527 - DNA, 21 bp, Artificial Sequence
  Synthetic Oligonucleotide
caatttctactgacggtagat

SEQ ID NO: 1528 - DNA, 22 bp, Artificial Sequence
  Synthetic Oligonucleotide
caatttctactgaccagtagat

SEQ ID NO: 1529 - DNA, 20 bp, Artificial Sequence
  Synthetic Oligonucleotide
caatttctactcgtgtagat

SEQ ID NO: 1530 - DNA, 22 bp, Artificial Sequence
  Synthetic Oligonucleotide
caatttctactcagaagtagat

SEQ ID NO: 1531 - DNA, 22 bp, Artificial Sequence
  Synthetic Oligonucleotide
caatttctactatcatgtagat

SEQ ID NO: 1532 - DNA, 22 bp, Artificial Sequence
  Synthetic Oligonucleotide
caatttctacctaatcgtagat

SEQ ID NO: 1533 - DNA, 22 bp, Artificial Sequence
  Synthetic Oligonucleotide
caatttctacgaacctgtagat

SEQ ID NO: 1534 - DNA, 22 bp, Artificial Sequence
  Synthetic Oligonucleotide
gaatttctactgccccgtagat

SEQ ID NO: 1535 - DNA, 22 bp, Artificial Sequence
  Synthetic Oligonucleotide
caatttctactcaacagtagat

SEQ ID NO: 1536 - DNA, 21 bp, Artificial Sequence
  Synthetic Oligonucleotide
caatttctcctacggggagat

SEQ ID NO: 1537 - DNA, 22 bp, Artificial Sequence
  Synthetic Oligonucleotide
caatttctactgttcggtagat

SEQ ID NO: 1538 - DNA, 21 bp, Artificial Sequence
  Synthetic Oligonucleotide
aaatttctcctacaaggagat

SEQ ID NO: 1539 - DNA, 22 bp, Artificial Sequence
  Synthetic Oligonucleotide
gaatttctactctcctgtagat

SEQ ID NO: 1540 - DNA, 22 bp, Artificial Sequence
  Synthetic Oligonucleotide
caatttctactctcgtgtagat

SEQ ID NO: 1541 - DNA, 21 bp, Artificial Sequence
  Synthetic Oligonucleotide
gaatttctccccgagggagat

SEQ ID NO: 1542 - DNA, 21 bp, Artificial Sequence
  Synthetic Oligonucleotide
caatttctcctcggcggagat

SEQ ID NO: 1543 - DNA, 22 bp, Artificial Sequence
  Synthetic Oligonucleotide
gaatttctactgcccggtagat

SEQ ID NO: 1544 - DNA, 22 bp, Artificial Sequence
  Synthetic Oligonucleotide
gaatttctactgcgcggtagat

SEQ ID NO: 1545 - DNA, 21 bp, Artificial Sequence
  Synthetic Oligonucleotide
caattgaggttaagtgtttct

SEQ ID NO: 1546 - DNA, 22 bp, Artificial Sequence
  Synthetic Oligonucleotide
caatttctacttcgtcgtagat

SEQ ID NO: 1547 - DNA, 21 bp, Artificial Sequence
  Synthetic Oligonucleotide
caattaattgtaagtcgattt

SEQ ID NO: 1548 - DNA, 21 bp, Artificial Sequence
  Synthetic Oligonucleotide
aaatttctccacgcaggagat

SEQ ID NO: 1549 - DNA, 21 bp, Artificial Sequence
  Synthetic Oligonucleotide
gaatttctactcctagtagat

SEQ ID NO: 1550 - DNA, 22 bp, Artificial Sequence
  Synthetic Oligonucleotide
caatttctcctacccgggagat

SEQ ID NO: 1551 - DNA, 21 bp, Artificial Sequence
  Synthetic Oligonucleotide
gaatttctacctactgtagat

SEQ ID NO: 1552 - DNA, 22 bp, Artificial Sequence
  Synthetic Oligonucleotide
caatttctcctacttcggagat

SEQ ID NO: 1553 - DNA, 22 bp, Artificial Sequence
  Synthetic Oligonucleotide
caatttctactgacccgtagat

SEQ ID NO: 1554 - DNA, 22 bp, Artificial Sequence
  Synthetic Oligonucleotide
caatttctacagcagagtagat

SEQ ID NO: 1555 - DNA, 22 bp, Artificial Sequence
  Synthetic Oligonucleotide
gaatttctaccacagagtagat

SEQ ID NO: 1556 - DNA, 22 bp, Artificial Sequence
  Synthetic Oligonucleotide
caatttctaccatggcgtagat

SEQ ID NO: 1557 - DNA, 20 bp, Artificial Sequence
  Synthetic Oligonucleotide
gaatttctactatggtagat

SEQ ID NO: 1558 - DNA, 21 bp, Artificial Sequence
  Synthetic Oligonucleotide
gaattcgacttaagtggtcgt

SEQ ID NO: 1559 - DNA, 20 bp, Artificial Sequence
  Synthetic Oligonucleotide
gaattgcggttcttgtcgct

SEQ ID NO: 1560 - DNA, 22 bp, Artificial Sequence
  Synthetic Oligonucleotide
caatttctactacagagtagat

SEQ ID NO: 1561 - DNA, 22 bp, Artificial Sequence
  Synthetic Oligonucleotide
gaatttctcctagggaggagat

SEQ ID NO: 1562 - DNA, 20 bp, Artificial Sequence
  Synthetic Oligonucleotide
gaattgtcgttcttgtggct

SEQ ID NO: 1563 - DNA, 22 bp, Artificial Sequence
  Synthetic Oligonucleotide
caatttctactttatggtagat

SEQ ID NO: 1564 - DNA, 20 bp, Artificial Sequence
  Synthetic Oligonucleotide
caattgtggttcttattatt

SEQ ID NO: 1565 - DNA, 22 bp, Artificial Sequence
  Synthetic Oligonucleotide
gaatttctactagctggtagat

SEQ ID NO: 1566 - DNA, 20 bp, Artificial Sequence
  Synthetic Oligonucleotide
aaattgggcgtcttcgtctt

SEQ ID NO: 1567 - DNA, 22 bp, Artificial Sequence
  Synthetic Oligonucleotide
caatttctactatcctgtagat

SEQ ID NO: 1568 - DNA, 21 bp, Artificial Sequence
  Synthetic Oligonucleotide
caatttctacacttcgtagat

SEQ ID NO: 1569 - DNA, 22 bp, Artificial Sequence
  Synthetic Oligonucleotide
caatttctacaattgggtagat

SEQ ID NO: 1570 - DNA, 21 bp, Artificial Sequence
  Synthetic Oligonucleotide
caatttctactgagggtagat

SEQ ID NO: 1571 - DNA, 21 bp, Artificial Sequence
  Synthetic Oligonucleotide
caattaggtctaagtggcctt

SEQ ID NO: 1572 - DNA, 21 bp, Artificial Sequence
  Synthetic Oligonucleotide
caatttctaccaggtgtagat

SEQ ID NO: 1573 - DNA, 22 bp, Artificial Sequence
  Synthetic Oligonucleotide
gaatttctacaaagcggtagat

SEQ ID NO: 1574 - DNA, 21 bp, Artificial Sequence
  Synthetic Oligonucleotide
caattcatgttaagtgcgtgt

SEQ ID NO: 1575 - DNA, 22 bp, Artificial Sequence
  Synthetic Oligonucleotide
gaatttctacaagtgtgtagat

SEQ ID NO: 1576 - DNA, 21 bp, Artificial Sequence
  Synthetic Oligonucleotide
caatttctacctacagtagat

SEQ ID NO: 1577 - DNA, 22 bp, Artificial Sequence
  Synthetic Oligonucleotide
caatttctccggagaaggagat

SEQ ID NO: 1578 - DNA, 22 bp, Artificial Sequence
  Synthetic Oligonucleotide
caatttctactagttcgtagat

SEQ ID NO: 1579 - DNA, 20 bp, Artificial Sequence
  Synthetic Oligonucleotide
gaattacctgtcttcgggtt

SEQ ID NO: 1580 - DNA, 21 bp, Artificial Sequence
  Synthetic Oligonucleotide
caattatttgtaagtcggatt

SEQ ID NO: 1581 - DNA, 22 bp, Artificial Sequence
  Synthetic Oligonucleotide
gaatttctactatagcgtagat

SEQ ID NO: 1582 - DNA, 22 bp, Artificial Sequence
  Synthetic Oligonucleotide
gaatttctcctaacctggagat

SEQ ID NO: 1583 - DNA, 22 bp, Artificial Sequence
  Synthetic Oligonucleotide
gaatttctactactcggtagat

SEQ ID NO: 1584 - DNA, 22 bp, Artificial Sequence
  Synthetic Oligonucleotide
caatttctactcacaggtagat

SEQ ID NO: 1585 - DNA, 20 bp, Artificial Sequence
  Synthetic Oligonucleotide
caatttctactattgtagat

SEQ ID NO: 1586 - DNA, 22 bp, Artificial Sequence
  Synthetic Oligonucleotide
caatttctactcttcggtagat

SEQ ID NO: 1587 - DNA, 22 bp, Artificial Sequence
  Synthetic Oligonucleotide
caatttctactcacatgtagat

SEQ ID NO: 1588 - DNA, 21 bp, Artificial Sequence
  Synthetic Oligonucleotide
caatttctactaaaagtagat

SEQ ID NO: 1589 - DNA, 22 bp, Artificial Sequence
  Synthetic Oligonucleotide
caatttctactcagccgtagat

SEQ ID NO: 1590 - DNA, 21 bp, Artificial Sequence
  Synthetic Oligonucleotide
gaatttctcctaattggagat

SEQ ID NO: 1591 - DNA, 21 bp, Artificial Sequence
  Synthetic Oligonucleotide
caatttctcctattaggagat

SEQ ID NO: 1592 - DNA, 21 bp, Artificial Sequence
  Synthetic Oligonucleotide
gaatttctacccatcgtagat

SEQ ID NO: 1593 - DNA, 21 bp, Artificial Sequence
  Synthetic Oligonucleotide
caatttctacaacaggtagat

SEQ ID NO: 1594 - DNA, 20 bp, Artificial Sequence
  Synthetic Oligonucleotide
caattacgtctcttgacgtt

SEQ ID NO: 1595 - DNA, 22 bp, Artificial Sequence
  Synthetic Oligonucleotide
caatttctaccgcggcgtagat

SEQ ID NO: 1596 - DNA, 21 bp, Artificial Sequence
  Synthetic Oligonucleotide
gaatttgcgataagtttgtgt

SEQ ID NO: 1597 - DNA, 21 bp, Artificial Sequence
  Synthetic Oligonucleotide
caattattcgtaagttgagtt

SEQ ID NO: 1598 - DNA, 21 bp, Artificial Sequence
  Synthetic Oligonucleotide
caatttctacatggtgtagat

SEQ ID NO: 1599 - DNA, 21 bp, Artificial Sequence
  Synthetic Oligonucleotide
gaatttctaccgcacgtagat

SEQ ID NO: 1600 - DNA, 21 bp, Artificial Sequence
  Synthetic Oligonucleotide
caatttctactggctgtagat

SEQ ID NO: 1601 - DNA, 22 bp, Artificial Sequence
  Synthetic Oligonucleotide
aaatttctcctaagttggagat

SEQ ID NO: 1602 - DNA, 20 bp, Artificial Sequence
  Synthetic Oligonucleotide
caattgtacatctttgtatt

SEQ ID NO: 1603 - DNA, 21 bp, Artificial Sequence
  Synthetic Oligonucleotide
caatttttcgtaagttgggat

SEQ ID NO: 1604 - DNA, 21 bp, Artificial Sequence
  Synthetic Oligonucleotide
caattggctgtaagttggctt

SEQ ID NO: 1605 - DNA, 21 bp, Artificial Sequence
  Synthetic Oligonucleotide
caatttctaccgttcgtagat

SEQ ID NO: 1606 - DNA, 21 bp, Artificial Sequence
  Synthetic Oligonucleotide
caattgtggataagtttcgtt

SEQ ID NO: 1607 - DNA, 21 bp, Artificial Sequence
  Synthetic Oligonucleotide
caattgttgataagttcaact

SEQ ID NO: 1608 - DNA, 22 bp, Artificial Sequence
  Synthetic Oligonucleotide
caatttctactcacaagtagat

SEQ ID NO: 1609 - DNA, 21 bp, Artificial Sequence
  Synthetic Oligonucleotide
caatttctacccaaggtagat

SEQ ID NO: 1610 - DNA, 22 bp, Artificial Sequence
  Synthetic Oligonucleotide
gaatttctccatgaagggagat

SEQ ID NO: 1611 - DNA, 22 bp, Artificial Sequence
  Synthetic Oligonucleotide
caatttctactctagtgtagat

SEQ ID NO: 1612 - DNA, 20 bp, Artificial Sequence
  Synthetic Oligonucleotide
caatttttgctcttgcaaat

SEQ ID NO: 1613 - DNA, 20 bp, Artificial Sequence
  Synthetic Oligonucleotide
caattaaggctcttgccttt

SEQ ID NO: 1614 - DNA, 20 bp, Artificial Sequence
  Synthetic Oligonucleotide
caattctgtgtctttgtagt

SEQ ID NO: 1615 - DNA, 22 bp, Artificial Sequence
  Synthetic Oligonucleotide
caatttctacttatgtgtagat

SEQ ID NO: 1616 - DNA, 21 bp, Artificial Sequence
  Synthetic Oligonucleotide
gaatttctccactcgggagat

SEQ ID NO: 1617 - DNA, 20 bp, Artificial Sequence
  Synthetic Oligonucleotide
caatttctcctgttggagat

SEQ ID NO: 1618 - DNA, 22 bp, Artificial Sequence
  Synthetic Oligonucleotide
caatttctacgatttggtagat

SEQ ID NO: 1619 - DNA, 21 bp, Artificial Sequence
  Synthetic Oligonucleotide
caatttctccttcgcggagat

SEQ ID NO: 1620 - DNA, 22 bp, Artificial Sequence
  Synthetic Oligonucleotide
aaatttctaccatcttgtagat

SEQ ID NO: 1621 - DNA, 20 bp, Artificial Sequence
  Synthetic Oligonucleotide
caattccgcctcttggcggt

SEQ ID NO: 1622 - DNA, 22 bp, Artificial Sequence
  Synthetic Oligonucleotide
caatttctcctaggttggagat

SEQ ID NO: 1623 - DNA, 21 bp, Artificial Sequence
  Synthetic Oligonucleotide
caattgtttttaagtgaagct

SEQ ID NO: 1624 - DNA, 21 bp, Artificial Sequence
  Synthetic Oligonucleotide
caatttctactgtcagtagat

SEQ ID NO: 1625 - DNA, 21 bp, Artificial Sequence
  Synthetic Oligonucleotide
caatttctcctaccaggagat

SEQ ID NO: 1626 - DNA, 22 bp, Artificial Sequence
  Synthetic Oligonucleotide
gaatttctacttccacgtagat

SEQ ID NO: 1627 - DNA, 21 bp, Artificial Sequence
  Synthetic Oligonucleotide
gaatttctcctttgtggagat

SEQ ID NO: 1628 - DNA, 20 bp, Artificial Sequence
  Synthetic Oligonucleotide
caatttctactcatgtagat

SEQ ID NO: 1629 - DNA, 22 bp, Artificial Sequence
  Synthetic Oligonucleotide
gaatttctacccgggcgtagat

SEQ ID NO: 1630 - DNA, 21 bp, Artificial Sequence
  Synthetic Oligonucleotide
caattcgaactaagtgtttgt

SEQ ID NO: 1631 - DNA, 22 bp, Artificial Sequence
  Synthetic Oligonucleotide
caatttctactacctagtagat

SEQ ID NO: 1632 - DNA, 22 bp, Artificial Sequence
  Synthetic Oligonucleotide
caatttctactggctcgtagat

SEQ ID NO: 1633 - DNA, 22 bp, Artificial Sequence
  Synthetic Oligonucleotide
gaatttctacaaagttgtagat

SEQ ID NO: 1634 - DNA, 22 bp, Artificial Sequence
  Synthetic Oligonucleotide
gaatttctacagagcagtagat

SEQ ID NO: 1635 - DNA, 22 bp, Artificial Sequence
  Synthetic Oligonucleotide
gaatttctactggccggtagat

SEQ ID NO: 1636 - DNA, 20 bp, Artificial Sequence
  Synthetic Oligonucleotide
caattagtgctcttgcgttt

SEQ ID NO: 1637 - DNA, 21 bp, Artificial Sequence
  Synthetic Oligonucleotide
gaatttctactcccggtagat

SEQ ID NO: 1638 - DNA, 22 bp, Artificial Sequence
  Synthetic Oligonucleotide
caatttctactagaaagtagat

SEQ ID NO: 1639 - DNA, 21 bp, Artificial Sequence
  Synthetic Oligonucleotide
caatttctactgcaagtagat

SEQ ID NO: 1640 - DNA, 21 bp, Artificial Sequence
  Synthetic Oligonucleotide
caatttctacgctacgtagat

SEQ ID NO: 1641 - DNA, 20 bp, Artificial Sequence
  Synthetic Oligonucleotide
caattttcgatctttcgagt

SEQ ID NO: 1642 - DNA, 22 bp, Artificial Sequence
  Synthetic Oligonucleotide
gaatttctccttgtgtggagat

SEQ ID NO: 1643 - DNA, 22 bp, Artificial Sequence
  Synthetic Oligonucleotide
gaatttctacttgtctgtagat

SEQ ID NO: 1644 - DNA, 21 bp, Artificial Sequence
  Synthetic Oligonucleotide
caatttctaccataagtagat

SEQ ID NO: 1645 - DNA, 21 bp, Artificial Sequence
  Synthetic Oligonucleotide
aaatttctcctaagaggagat

SEQ ID NO: 1646 - DNA, 20 bp, Artificial Sequence
  Synthetic Oligonucleotide
caatttctactgatgtagat

SEQ ID NO: 1647 - DNA, 22 bp, Artificial Sequence
  Synthetic Oligonucleotide
caatttctacataatggtagat

SEQ ID NO: 1648 - DNA, 22 bp, Artificial Sequence
  Synthetic Oligonucleotide
caatttctactgcgcggtagat

SEQ ID NO: 1649 - DNA, 21 bp, Artificial Sequence
  Synthetic Oligonucleotide
gaatttctaccgtccgtagat

SEQ ID NO: 1650 - DNA, 21 bp, Artificial Sequence
  Synthetic Oligonucleotide
caatttctactactagtagat

SEQ ID NO: 1651 - DNA, 21 bp, Artificial Sequence
  Synthetic Oligonucleotide
caatttctactacttgtagat

SEQ ID NO: 1652 - DNA, 22 bp, Artificial Sequence
  Synthetic Oligonucleotide
caatttctactgtaccgtagat

SEQ ID NO: 1653 - DNA, 22 bp, Artificial Sequence
  Synthetic Oligonucleotide
caatttctcccgaagtggagat

SEQ ID NO: 1654 - DNA, 20 bp, Artificial Sequence
  Synthetic Oligonucleotide
caattttcagtcttctggat

SEQ ID NO: 1655 - DNA, 21 bp, Artificial Sequence
  Synthetic Oligonucleotide
aaatttctactaagtgtggat

SEQ ID NO: 1656 - DNA, 21 bp, Artificial Sequence
  Synthetic Oligonucleotide
caatttctcctttccggagat

SEQ ID NO: 1657 - DNA, 20 bp, Artificial Sequence
  Synthetic Oligonucleotide
caattgtttatctttgggct

SEQ ID NO: 1658 - DNA, 21 bp, Artificial Sequence
  Synthetic Oligonucleotide
gaatttctacacaacgtagat

SEQ ID NO: 1659 - DNA, 21 bp, Artificial Sequence
  Synthetic Oligonucleotide
caatttagtgtaagttgttat

SEQ ID NO: 1660 - DNA, 20 bp, Artificial Sequence
  Synthetic Oligonucleotide
caattgctaatcttttggtt

SEQ ID NO: 1661 - DNA, 22 bp, Artificial Sequence
  Synthetic Oligonucleotide
caatttctactgtctagtagat

SEQ ID NO: 1662 - DNA, 21 bp, Artificial Sequence
  Synthetic Oligonucleotide
gaatttctactatacgtagat

SEQ ID NO: 1663 - DNA, 22 bp, Artificial Sequence
  Synthetic Oligonucleotide
caatttctacgcctaggtagat

SEQ ID NO: 1664 - DNA, 22 bp, Artificial Sequence
  Synthetic Oligonucleotide
caatttctccttgtgcggagat

SEQ ID NO: 1665 - DNA, 21 bp, Artificial Sequence
  Synthetic Oligonucleotide
caatttctacgccgcgtagat

SEQ ID NO: 1666 - DNA, 21 bp, Artificial Sequence
  Synthetic Oligonucleotide
caatttctacgccgtgtagat

SEQ ID NO: 1667 - DNA, 22 bp, Artificial Sequence
  Synthetic Oligonucleotide
gaatttctaccctgatgtagat

SEQ ID NO: 1668 - DNA, 22 bp, Artificial Sequence
  Synthetic Oligonucleotide
caatttctactatgtcgtagat

SEQ ID NO: 1669 - DNA, 22 bp, Artificial Sequence
  Synthetic Oligonucleotide
caatttctacttagatgtagat

SEQ ID NO: 1670 - DNA, 20 bp, Artificial Sequence
  Synthetic Oligonucleotide
caatttctactgccgtagat

SEQ ID NO: 1671 - DNA, 20 bp, Artificial Sequence
  Synthetic Oligonucleotide
caattgtttatctttaggct

SEQ ID NO: 1672 - DNA, 21 bp, Artificial Sequence
  Synthetic Oligonucleotide
caattgcccataagttgggtt

SEQ ID NO: 1673 - DNA, 21 bp, Artificial Sequence
  Synthetic Oligonucleotide
caattttcgctaagtgcgggt

SEQ ID NO: 1674 - DNA, 21 bp, Artificial Sequence
  Synthetic Oligonucleotide
gaatttctactctgtgtagat

SEQ ID NO: 1675 - DNA, 21 bp, Artificial Sequence
  Synthetic Oligonucleotide
caatttctactagccgtagat

SEQ ID NO: 1676 - DNA, 20 bp, Artificial Sequence
  Synthetic Oligonucleotide
caattcccgatctttcgggt

SEQ ID NO: 1677 - DNA, 21 bp, Artificial Sequence
  Synthetic Oligonucleotide
gaattcggtctaagtggccgt

SEQ ID NO: 1678 - DNA, 21 bp, Artificial Sequence
  Synthetic Oligonucleotide
caatttctactgtaagtagat

SEQ ID NO: 1679 - DNA, 21 bp, Artificial Sequence
  Synthetic Oligonucleotide
caatttctactgtaggtagat

SEQ ID NO: 1680 - DNA, 22 bp, Artificial Sequence
  Synthetic Oligonucleotide
caatttctacttgtgtgtagat

SEQ ID NO: 1681 - DNA, 22 bp, Artificial Sequence
  Synthetic Oligonucleotide
gaatttctcctcgaatggagat

SEQ ID NO: 1682 - DNA, 22 bp, Artificial Sequence
  Synthetic Oligonucleotide
gaatttctacatgccagtagat

SEQ ID NO: 1683 - DNA, 22 bp, Artificial Sequence
  Synthetic Oligonucleotide
caatttctaccctgtggtagat

SEQ ID NO: 1684 - DNA, 22 bp, Artificial Sequence
  Synthetic Oligonucleotide
caatttctactgctcagtagat

SEQ ID NO: 1685 - DNA, 21 bp, Artificial Sequence
  Synthetic Oligonucleotide
aaatttgctgtaagtcggcgt

SEQ ID NO: 1686 - DNA, 21 bp, Artificial Sequence
  Synthetic Oligonucleotide
caatttctactcctggtagat

SEQ ID NO: 1687 - DNA, 22 bp, Artificial Sequence
  Synthetic Oligonucleotide
aaatttctacgcgttggtagat

SEQ ID NO: 1688 - DNA, 22 bp, Artificial Sequence
  Synthetic Oligonucleotide
caatttctactcccacgtagat

SEQ ID NO: 1689 - DNA, 20 bp, Artificial Sequence
  Synthetic Oligonucleotide
caattcgccttcttgggcgt

SEQ ID NO: 1690 - DNA, 22 bp, Artificial Sequence
  Synthetic Oligonucleotide
gaatttctactccctagtagat

SEQ ID NO: 1691 - DNA, 21 bp, Artificial Sequence
  Synthetic Oligonucleotide
gaattgccgttaagtgcggct

SEQ ID NO: 1692 - DNA, 20 bp, Artificial Sequence
  Synthetic Oligonucleotide
caattttccttcttaggggt

SEQ ID NO: 1693 - DNA, 20 bp, Artificial Sequence
  Synthetic Oligonucleotide
caattctgcgtctttgtggt

SEQ ID NO: 1694 - DNA, 22 bp, Artificial Sequence
  Synthetic Oligonucleotide
caatttctactagggagtagat

SEQ ID NO: 1695 - DNA, 21 bp, Artificial Sequence
  Synthetic Oligonucleotide
caattgggtgtaagttatctt

SEQ ID NO: 1696 - DNA, 22 bp, Artificial Sequence
  Synthetic Oligonucleotide
caatttctactctcctgtagat

SEQ ID NO: 1697 - DNA, 20 bp, Artificial Sequence
  Synthetic Oligonucleotide
gaattggtcttcttggatct

SEQ ID NO: 1698 - DNA, 22 bp, Artificial Sequence
  Synthetic Oligonucleotide
caatttctactcgttggtagat

SEQ ID NO: 1699 - DNA, 21 bp, Artificial Sequence
  Synthetic Oligonucleotide
caatttctcctttgcggagat

SEQ ID NO: 1700 - DNA, 22 bp, Artificial Sequence
  Synthetic Oligonucleotide
caatttctactccccggtagat

SEQ ID NO: 1701 - DNA, 21 bp, Artificial Sequence
  Synthetic Oligonucleotide
caattgtaattaagtattact

SEQ ID NO: 1702 - DNA, 22 bp, Artificial Sequence
  Synthetic Oligonucleotide
caatttctactcttccgtagat

SEQ ID NO: 1703 - DNA, 21 bp, Artificial Sequence
  Synthetic Oligonucleotide
gaatttggcgtaagtcgccat

SEQ ID NO: 1704 - DNA, 22 bp, Artificial Sequence
  Synthetic Oligonucleotide
caatttctactccaaggtagat

SEQ ID NO: 1705 - DNA, 20 bp, Artificial Sequence
  Synthetic Oligonucleotide
caattagtcttcttggattt

SEQ ID NO: 1706 - DNA, 22 bp, Artificial Sequence
  Synthetic Oligonucleotide
caatttctacactcgtgtagat

SEQ ID NO: 1707 - DNA, 22 bp, Artificial Sequence
  Synthetic Oligonucleotide
gaatttctactatggcgtagat

SEQ ID NO: 1708 - DNA, 22 bp, Artificial Sequence
  Synthetic Oligonucleotide
caatttctcctggcatggagat

SEQ ID NO: 1709 - DNA, 22 bp, Artificial Sequence
  Synthetic Oligonucleotide
caatttctccacaacgggagat

SEQ ID NO: 1710 - DNA, 22 bp, Artificial Sequence
  Synthetic Oligonucleotide
caatttctcctcaagcggagat

SEQ ID NO: 1711 - DNA, 21 bp, Artificial Sequence
  Synthetic Oligonucleotide
caatttctcctataaggagat

SEQ ID NO: 1712 - DNA, 22 bp, Artificial Sequence
  Synthetic Oligonucleotide
caatttctactcgggcgtagat

SEQ ID NO: 1713 - DNA, 21 bp, Artificial Sequence
  Synthetic Oligonucleotide
caattggcagtaagtttgtct

SEQ ID NO: 1714 - DNA, 22 bp, Artificial Sequence
  Synthetic Oligonucleotide
caatttctacttatatgtagat

SEQ ID NO: 1715 - DNA, 22 bp, Artificial Sequence
  Synthetic Oligonucleotide
caatttctccttccgtggagat

SEQ ID NO: 1716 - DNA, 22 bp, Artificial Sequence
  Synthetic Oligonucleotide
caatttctactctctcgtagat

SEQ ID NO: 1717 - DNA, 22 bp, Artificial Sequence
  Synthetic Oligonucleotide
gaatttctccacagaaggagat

SEQ ID NO: 1718 - DNA, 22 bp, Artificial Sequence
  Synthetic Oligonucleotide
caatttctactgcaaagtagat

SEQ ID NO: 1719 - DNA, 22 bp, Artificial Sequence
  Synthetic Oligonucleotide
gaatttctcctagcgtggagat

SEQ ID NO: 1720 - DNA, 22 bp, Artificial Sequence
  Synthetic Oligonucleotide
caatttctactgctgcgtagat

SEQ ID NO: 1721 - DNA, 21 bp, Artificial Sequence
  Synthetic Oligonucleotide
caatttctactcgcagtagat

SEQ ID NO: 1722 - DNA, 21 bp, Artificial Sequence
  Synthetic Oligonucleotide
caatttctacaggtggtagat

SEQ ID NO: 1723 - DNA, 22 bp, Artificial Sequence
  Synthetic Oligonucleotide
caatttctcctatcctggagat

SEQ ID NO: 1724 - DNA, 22 bp, Artificial Sequence
  Synthetic Oligonucleotide
caatttctactcgtgtgtagat

SEQ ID NO: 1725 - DNA, 20 bp, Artificial Sequence
  Synthetic Oligonucleotide
caatttctactgaggtagat

SEQ ID NO: 1726 - DNA, 21 bp, Artificial Sequence
  Synthetic Oligonucleotide
gaatttctacctcgtgtagat

SEQ ID NO: 1727 - DNA, 22 bp, Artificial Sequence
  Synthetic Oligonucleotide
gaatttctacccctgggtagat

SEQ ID NO: 1728 - DNA, 21 bp, Artificial Sequence
  Synthetic Oligonucleotide
caatttctacttttggtagat

SEQ ID NO: 1729 - DNA, 20 bp, Artificial Sequence
  Synthetic Oligonucleotide
gaattgctcgtcttcgggct

SEQ ID NO: 1730 - DNA, 22 bp, Artificial Sequence
  Synthetic Oligonucleotide
gaatttctactgtactgtagat

SEQ ID NO: 1731 - DNA, 22 bp, Artificial Sequence
  Synthetic Oligonucleotide
aaatttctactaccacgtagat

SEQ ID NO: 1732 - DNA, 20 bp, Artificial Sequence
  Synthetic Oligonucleotide
gaatttctactcttgtagat

SEQ ID NO: 1733 - DNA, 21 bp, Artificial Sequence
  Synthetic Oligonucleotide
caatttctactagaagtagat

SEQ ID NO: 1734 - DNA, 20 bp, Artificial Sequence
  Synthetic Oligonucleotide
aaatttctactctcgtagat

SEQ ID NO: 1735 - DNA, 20 bp, Artificial Sequence
  Synthetic Oligonucleotide
caatttctactagagtagat

SEQ ID NO: 1736 - DNA, 22 bp, Artificial Sequence
  Synthetic Oligonucleotide
gaatttctactacggagtagat

SEQ ID NO: 1737 - DNA, 22 bp, Artificial Sequence
  Synthetic Oligonucleotide
gaatttctactagatcgtagat

SEQ ID NO: 1738 - DNA, 20 bp, Artificial Sequence
  Synthetic Oligonucleotide
gaattttcgttcttacggat

SEQ ID NO: 1739 - DNA, 21 bp, Artificial Sequence
  Synthetic Oligonucleotide
caattcactgtaagttggtgt

SEQ ID NO: 1740 - DNA, 20 bp, Artificial Sequence
  Synthetic Oligonucleotide
gaatttctactagtgtagat

SEQ ID NO: 1741 - DNA, 22 bp, Artificial Sequence
  Synthetic Oligonucleotide
gaatttctacttatacgtagat

SEQ ID NO: 1742 - DNA, 21 bp, Artificial Sequence
  Synthetic Oligonucleotide
gaatttctacttacagtagat

SEQ ID NO: 1743 - DNA, 21 bp, Artificial Sequence
  Synthetic Oligonucleotide
aaatttctccatcccggagat

SEQ ID NO: 1744 - DNA, 20 bp, Artificial Sequence
  Synthetic Oligonucleotide
caattagtattcttatactt

SEQ ID NO: 1745 - DNA, 20 bp, Artificial Sequence
  Synthetic Oligonucleotide
caatttctcctattggagat

SEQ ID NO: 1746 - DNA, 22 bp, Artificial Sequence
  Synthetic Oligonucleotide
gaatttctactaataagtagat

SEQ ID NO: 1747 - DNA, 20 bp, Artificial Sequence
  Synthetic Oligonucleotide
gaattagtggtcttccgctt

SEQ ID NO: 1748 - DNA, 22 bp, Artificial Sequence
  Synthetic Oligonucleotide
gaatttctacttccatgtagat

SEQ ID NO: 1749 - DNA, 22 bp, Artificial Sequence
  Synthetic Oligonucleotide
gaatttctactgtagcgtagat

SEQ ID NO: 1750 - DNA, 20 bp, Artificial Sequence
  Synthetic Oligonucleotide
aaattgtctgtcttcaggtt

SEQ ID NO: 1751 - DNA, 21 bp, Artificial Sequence
  Synthetic Oligonucleotide
gaatttctacttcctgtagat

SEQ ID NO: 1752 - DNA, 22 bp, Artificial Sequence
  Synthetic Oligonucleotide
gaatttctactgcttcgtagat

SEQ ID NO: 1753 - DNA, 22 bp, Artificial Sequence
  Synthetic Oligonucleotide
aaatttctactgccacgtagat

SEQ ID NO: 1754 - DNA, 20 bp, Artificial Sequence
  Synthetic Oligonucleotide
gaatttctcctattggagat

SEQ ID NO: 1755 - DNA, 21 bp, Artificial Sequence
  Synthetic Oligonucleotide
caattatttctaagtggggtt

SEQ ID NO: 1756 - DNA, 21 bp, Artificial Sequence
  Synthetic Oligonucleotide
caatttctacttatcgtagat

SEQ ID NO: 1757 - DNA, 21 bp, Artificial Sequence
  Synthetic Oligonucleotide
gaattctgtgtaagttgtggt

SEQ ID NO: 1758 - DNA, 21 bp, Artificial Sequence
  Synthetic Oligonucleotide
caatttctactacatgtagat

SEQ ID NO: 1759 - DNA, 22 bp, Artificial Sequence
  Synthetic Oligonucleotide
gaatttctactgtaatgtagat

SEQ ID NO: 1760 - DNA, 20 bp, Artificial Sequence
  Synthetic Oligonucleotide
caatttctactatcgtagat

SEQ ID NO: 1761 - DNA, 22 bp, Artificial Sequence
  Synthetic Oligonucleotide
gaatttctactggtacgtagat

SEQ ID NO: 1762 - DNA, 21 bp, Artificial Sequence
  Synthetic Oligonucleotide
caattgagactaagtgttttt

SEQ ID NO: 1763 - DNA, 21 bp, Artificial Sequence
  Synthetic Oligonucleotide
aaatttctacttgcagtagat

SEQ ID NO: 1764 - DNA, 20 bp, Artificial Sequence
  Synthetic Oligonucleotide
caatttctactaatgtagat

SEQ ID NO: 1765 - DNA, 21 bp, Artificial Sequence
  Synthetic Oligonucleotide
gaatttctactgacagtagat

SEQ ID NO: 1766 - DNA, 20 bp, Artificial Sequence
  Synthetic Oligonucleotide
aaatttctactaaagtagat

SEQ ID NO: 1767 - DNA, 21 bp, Artificial Sequence
  Synthetic Oligonucleotide
aaatttctactgaatgtagat

SEQ ID NO: 1768 - DNA, 20 bp, Artificial Sequence
  Synthetic Oligonucleotide
caatttctactgtagtagat

SEQ ID NO: 1769 - DNA, 20 bp, Artificial Sequence
  Synthetic Oligonucleotide
caatttctcctatcggagat

SEQ ID NO: 1770 - DNA, 20 bp, Artificial Sequence
  Synthetic Oligonucleotide
caatttctactcaagtagat

SEQ ID NO: 1771 - DNA, 21 bp, Artificial Sequence
  Synthetic Oligonucleotide
caatttctactaaacgtagat

SEQ ID NO: 1772 - DNA, 21 bp, Artificial Sequence
  Synthetic Oligonucleotide
gaattgtacctaagtggtact

SEQ ID NO: 1773 - DNA, 20 bp, Artificial Sequence
  Synthetic Oligonucleotide
caatttctactttcgtagat

SEQ ID NO: 1774 - DNA, 20 bp, Artificial Sequence
  Synthetic Oligonucleotide
aaatttctcctgtcggagat

SEQ ID NO: 1775 - DNA, 22 bp, Artificial Sequence
  Synthetic Oligonucleotide
caatttctactcatccgtagat

SEQ ID NO: 1776 - DNA, 22 bp, Artificial Sequence
  Synthetic Oligonucleotide
gaatttctactgttatgtagat

SEQ ID NO: 1777 - DNA, 22 bp, Artificial Sequence
  Synthetic Oligonucleotide
gaatttctactactccgtagat

SEQ ID NO: 1778 - DNA, 21 bp, Artificial Sequence
  Synthetic Oligonucleotide
aaatttctactagttgtagat

SEQ ID NO: 1779 - DNA, 21 bp, Artificial Sequence
  Synthetic Oligonucleotide
caatttctactccaagtagat

SEQ ID NO: 1780 - DNA, 22 bp, Artificial Sequence
  Synthetic Oligonucleotide
gaatttctactgatccgtagat

SEQ ID NO: 1781 - DNA, 21 bp, Artificial Sequence
  Synthetic Oligonucleotide
caatttaggataagtttctgt

SEQ ID NO: 1782 - DNA, 20 bp, Artificial Sequence
  Synthetic Oligonucleotide
gaattgtgtgtctttacact

SEQ ID NO: 1783 - DNA, 21 bp, Artificial Sequence
  Synthetic Oligonucleotide
caattgcaagtaagttttgct

SEQ ID NO: 1784 - DNA, 20 bp, Artificial Sequence
  Synthetic Oligonucleotide
caatttctactctcgtagat

SEQ ID NO: 1785 - DNA, 22 bp, Artificial Sequence
  Synthetic Oligonucleotide
gaatttctactgatacgtagat

SEQ ID NO: 1786 - DNA, 22 bp, Artificial Sequence
  Synthetic Oligonucleotide
gaatttctactgaatcgtagat

SEQ ID NO: 1787 - DNA, 20 bp, Artificial Sequence
  Synthetic Oligonucleotide
aaattgggcatctttgctct

SEQ ID NO: 1788 - DNA, 22 bp, Artificial Sequence
  Synthetic Oligonucleotide
gaatttctacttgcgtgtagat

SEQ ID NO: 1789 - DNA, 22 bp, Artificial Sequence
  Synthetic Oligonucleotide
gaatttctacgtcagcgtagat

SEQ ID NO: 1790 - DNA, 21 bp, Artificial Sequence
  Synthetic Oligonucleotide
caattgaggttaagtaccttt

SEQ ID NO: 1791 - DNA, 20 bp, Artificial Sequence
  Synthetic Oligonucleotide
gaatttctactctagtagat

SEQ ID NO: 1792 - DNA, 22 bp, Artificial Sequence
  Synthetic Oligonucleotide
aaatttctacttgcatgtagat

SEQ ID NO: 1793 - DNA, 21 bp, Artificial Sequence
  Synthetic Oligonucleotide
gaatttctactacgtgtagat

SEQ ID NO: 1794 - DNA, 21 bp, Artificial Sequence
  Synthetic Oligonucleotide
aaatttctcctgctaggagat

SEQ ID NO: 1795 - DNA, 20 bp, Artificial Sequence
  Synthetic Oligonucleotide
caattggctatctttggctt

SEQ ID NO: 1796 - DNA, 22 bp, Artificial Sequence
  Synthetic Oligonucleotide
aaatttctacttacttgtagat

SEQ ID NO: 1797 - DNA, 22 bp, Artificial Sequence
  Synthetic Oligonucleotide
gaatttctactaacatgtagat

SEQ ID NO: 1798 - DNA, 21 bp, Artificial Sequence
  Synthetic Oligonucleotide
gaatttctactcccagtagat

SEQ ID NO: 1799 - DNA, 21 bp, Artificial Sequence
  Synthetic Oligonucleotide
gaatttctactgtgcgtagat

SEQ ID NO: 1800 - DNA, 21 bp, Artificial Sequence
  Synthetic Oligonucleotide
caatttctactgtctgtagat

SEQ ID NO: 1801 - DNA, 22 bp, Artificial Sequence
  Synthetic Oligonucleotide
aaatttctactcatacgtagat

SEQ ID NO: 1802 - DNA, 22 bp, Artificial Sequence
  Synthetic Oligonucleotide
caatttctacttttccgtagat

SEQ ID NO: 1803 - DNA, 22 bp, Artificial Sequence
  Synthetic Oligonucleotide
gaatttctactacactgtagat

SEQ ID NO: 1804 - DNA, 21 bp, Artificial Sequence
  Synthetic Oligonucleotide
gaatttctacttgaggtagat

SEQ ID NO: 1805 - DNA, 21 bp, Artificial Sequence
  Synthetic Oligonucleotide
gaattgggggtaagtcttcct

SEQ ID NO: 1806 - DNA, 20 bp, Artificial Sequence
  Synthetic Oligonucleotide
caatttctactgtcgtagat

SEQ ID NO: 1807 - DNA, 20 bp, Artificial Sequence
  Synthetic Oligonucleotide
caatttgctgtctttggcat

SEQ ID NO: 1808 - DNA, 22 bp, Artificial Sequence
  Synthetic Oligonucleotide
aaatttctacagccccgtagat

SEQ ID NO: 1809 - DNA, 21 bp, Artificial Sequence
  Synthetic Oligonucleotide
gaatttctactagctgtagat

SEQ ID NO: 1810 - DNA, 21 bp, Artificial Sequence
  Synthetic Oligonucleotide
caatttctacagttagtagat

SEQ ID NO: 1811 - DNA, 21 bp, Artificial Sequence
  Synthetic Oligonucleotide
caatttctactaactgtagat

SEQ ID NO: 1812 - DNA, 20 bp, Artificial Sequence
  Synthetic Oligonucleotide
caattgggtttcttgatctt

SEQ ID NO: 1813 - DNA, 20 bp, Artificial Sequence
  Synthetic Oligonucleotide
gaatttctcctgggggagat

SEQ ID NO: 1814 - DNA, 22 bp, Artificial Sequence
  Synthetic Oligonucleotide
gaatttctactgtattgtagat

SEQ ID NO: 1815 - DNA, 21 bp, Artificial Sequence
  Synthetic Oligonucleotide
gaatttctacttgcggtagat

SEQ ID NO: 1816 - DNA, 20 bp, Artificial Sequence
  Synthetic Oligonucleotide
gaatttctactaaagtagat

SEQ ID NO: 1817 - DNA, 22 bp, Artificial Sequence
  Synthetic Oligonucleotide
gaatttctccgtggctggagat

SEQ ID NO: 1818 - DNA, 20 bp, Artificial Sequence
  Synthetic Oligonucleotide
gaatttctcctatcggagat

SEQ ID NO: 1819 - DNA, 22 bp, Artificial Sequence
  Synthetic Oligonucleotide
caatttctactttcatgtagat

SEQ ID NO: 1820 - DNA, 20 bp, Artificial Sequence
  Synthetic Oligonucleotide
aaatttctactcgcgtagat

SEQ ID NO: 1821 - DNA, 21 bp, Artificial Sequence
  Synthetic Oligonucleotide
caatttctacagaaagtagat

SEQ ID NO: 1822 - DNA, 22 bp, Artificial Sequence
  Synthetic Oligonucleotide
gaatttctcccgtacaggagat

SEQ ID NO: 1823 - DNA, 20 bp, Artificial Sequence
  Synthetic Oligonucleotide
aaatttctactgaggtagat

SEQ ID NO: 1824 - DNA, 20 bp, Artificial Sequence
  Synthetic Oligonucleotide
aaatttctactcacgtagat

SEQ ID NO: 1825 - DNA, 20 bp, Artificial Sequence
  Synthetic Oligonucleotide
caattcttcctcttgggagt

SEQ ID NO: 1826 - DNA, 20 bp, Artificial Sequence
  Synthetic Oligonucleotide
gaatttctactcaagtagat

SEQ ID NO: 1827 - DNA, 21 bp, Artificial Sequence
  Synthetic Oligonucleotide
gaatttctccgccgaggagat

SEQ ID NO: 1828 - DNA, 22 bp, Artificial Sequence
  Synthetic Oligonucleotide
caatttctactaacctgtagat

SEQ ID NO: 1829 - DNA, 20 bp, Artificial Sequence
  Synthetic Oligonucleotide
caatttacgctcttgtgtgt

SEQ ID NO: 1830 - DNA, 20 bp, Artificial Sequence
  Synthetic Oligonucleotide
aaatttctactagcgtagat

SEQ ID NO: 1831 - DNA, 22 bp, Artificial Sequence
  Synthetic Oligonucleotide
aaatttctacttatacgtagat

SEQ ID NO: 1832 - DNA, 20 bp, Artificial Sequence
  Synthetic Oligonucleotide
caatttctaccacagtagat

SEQ ID NO: 1833 - DNA, 20 bp, Artificial Sequence
  Synthetic Oligonucleotide
caatttctcctctaggagat

SEQ ID NO: 1834 - DNA, 22 bp, Artificial Sequence
  Synthetic Oligonucleotide
caatttctactatattgtagat

SEQ ID NO: 1835 - DNA, 22 bp, Artificial Sequence
  Synthetic Oligonucleotide
gaatttctactattgcgtagat

SEQ ID NO: 1836 - DNA, 22 bp, Artificial Sequence
  Synthetic Oligonucleotide
gaatttctacttatccgtagat

SEQ ID NO: 1837 - DNA, 20 bp, Artificial Sequence
  Synthetic Oligonucleotide
caattgtgggtcttttcatt

SEQ ID NO: 1838 - DNA, 22 bp, Artificial Sequence
  Synthetic Oligonucleotide
aaatttctactctttagtagat

SEQ ID NO: 1839 - DNA, 21 bp, Artificial Sequence
  Synthetic Oligonucleotide
gaatttctactcagcgtagat

SEQ ID NO: 1840 - DNA, 22 bp, Artificial Sequence
  Synthetic Oligonucleotide
gaatttctccgtcgatggagat

SEQ ID NO: 1841 - DNA, 22 bp, Artificial Sequence
  Synthetic Oligonucleotide
gaatttctccccgcttggagat

SEQ ID NO: 1842 - DNA, 22 bp, Artificial Sequence
  Synthetic Oligonucleotide
caatttctacttatacgtagat

SEQ ID NO: 1843 - DNA, 21 bp, Artificial Sequence
  Synthetic Oligonucleotide
aaatttctactgtgtgtagat

SEQ ID NO: 1844 - DNA, 21 bp, Artificial Sequence
  Synthetic Oligonucleotide
aaatttctacttatggtagat

SEQ ID NO: 1845 - DNA, 22 bp, Artificial Sequence
  Synthetic Oligonucleotide
gaatttctactaatacgtagat

SEQ ID NO: 1846 - DNA, 22 bp, Artificial Sequence
  Synthetic Oligonucleotide
caatttctacatagtcgtagat

SEQ ID NO: 1847 - DNA, 22 bp, Artificial Sequence
  Synthetic Oligonucleotide
caatttctactatcgcgtagat

SEQ ID NO: 1848 - DNA, 20 bp, Artificial Sequence
  Synthetic Oligonucleotide
caattggttctcttgaatct

SEQ ID NO: 1849 - DNA, 22 bp, Artificial Sequence
  Synthetic Oligonucleotide
caatttctcccacgctggagat

SEQ ID NO: 1850 - DNA, 22 bp, Artificial Sequence
  Synthetic Oligonucleotide
gaatttctactatcttgtagat

SEQ ID NO: 1851 - DNA, 22 bp, Artificial Sequence
  Synthetic Oligonucleotide
caatttctacttcctcgtagat

SEQ ID NO: 1852 - DNA, 20 bp, Artificial Sequence
  Synthetic Oligonucleotide
caatttctactatagtagat

SEQ ID NO: 1853 - DNA, 21 bp, Artificial Sequence
  Synthetic Oligonucleotide
caatttctaccgcacgtagat

SEQ ID NO: 1854 - DNA, 20 bp, Artificial Sequence
  Synthetic Oligonucleotide
caatttctcctctgggagat

SEQ ID NO: 1855 - DNA, 21 bp, Artificial Sequence
  Synthetic Oligonucleotide
caattgtgcgtaagtcgcgct

SEQ ID NO: 1856 - DNA, 22 bp, Artificial Sequence
  Synthetic Oligonucleotide
caatttctacacccatgtagat

SEQ ID NO: 1857 - DNA, 20 bp, Artificial Sequence
  Synthetic Oligonucleotide
caattgtccttcttggggct

SEQ ID NO: 1858 - DNA, 21 bp, Artificial Sequence
  Synthetic Oligonucleotide
caatttctacaacctgtagat

SEQ ID NO: 1859 - DNA, 20 bp, Artificial Sequence
  Synthetic Oligonucleotide
gaatttctactgttgtagat

SEQ ID NO: 1860 - DNA, 20 bp, Artificial Sequence
  Synthetic Oligonucleotide
caatttctcctgtaggagat

SEQ ID NO: 1861 - DNA, 21 bp, Artificial Sequence
  Synthetic Oligonucleotide
aaatttctactcccagtagat

SEQ ID NO: 1862 - DNA, 21 bp, Artificial Sequence
  Synthetic Oligonucleotide
caatttctccctacgggagat

SEQ ID NO: 1863 - DNA, 22 bp, Artificial Sequence
  Synthetic Oligonucleotide
gaatttctaccctactgtagat

SEQ ID NO: 1864 - DNA, 20 bp, Artificial Sequence
  Synthetic Oligonucleotide
caattggtggtcttccgtct

SEQ ID NO: 1865 - DNA, 22 bp, Artificial Sequence
  Synthetic Oligonucleotide
aaatttctacccgatcgtagat

SEQ ID NO: 1866 - DNA, 22 bp, Artificial Sequence
  Synthetic Oligonucleotide
caatttctcctctaggggagat

SEQ ID NO: 1867 - DNA, 21 bp, Artificial Sequence
  Synthetic Oligonucleotide
aaatttctacttttggtagat

SEQ ID NO: 1868 - DNA, 21 bp, Artificial Sequence
  Synthetic Oligonucleotide
aaatttctacagaccgtagat

SEQ ID NO: 1869 - DNA, 20 bp, Artificial Sequence
  Synthetic Oligonucleotide
gaatttctactgacgtagat

SEQ ID NO: 1870 - DNA, 22 bp, Artificial Sequence
  Synthetic Oligonucleotide
aaatttctcctcacgtggagat

SEQ ID NO: 1871 - DNA, 22 bp, Artificial Sequence
  Synthetic Oligonucleotide
caatttctccgtagggggagat

SEQ ID NO: 1872 - DNA, 22 bp, Artificial Sequence
  Synthetic Oligonucleotide
gaatttctacttgaccgtagat

SEQ ID NO: 1873 - DNA, 21 bp, Artificial Sequence
  Synthetic Oligonucleotide
gaatttctactggtagtagat

SEQ ID NO: 1874 - DNA, 22 bp, Artificial Sequence
  Synthetic Oligonucleotide
gaatttctactatcctgtagat

SEQ ID NO: 1875 - DNA, 21 bp, Artificial Sequence
  Synthetic Oligonucleotide
caatttctccatcgtggagat

SEQ ID NO: 1876 - DNA, 22 bp, Artificial Sequence
  Synthetic Oligonucleotide
gaatttctactgacacgtagat

SEQ ID NO: 1877 - DNA, 21 bp, Artificial Sequence
  Synthetic Oligonucleotide
caatttctacacgacgtagat

SEQ ID NO: 1878 - DNA, 22 bp, Artificial Sequence
  Synthetic Oligonucleotide
aaatttctactggtttgtagat

SEQ ID NO: 1879 - DNA, 22 bp, Artificial Sequence
  Synthetic Oligonucleotide
aaatttctacttccacgtagat

SEQ ID NO: 1880 - DNA, 20 bp, Artificial Sequence
  Synthetic Oligonucleotide
caattgctgctcttgtggtt

SEQ ID NO: 1881 - DNA, 20 bp, Artificial Sequence
  Synthetic Oligonucleotide
gaatttctactcatgtagat

SEQ ID NO: 1882 - DNA, 22 bp, Artificial Sequence
  Synthetic Oligonucleotide
aaatttctactagaatgtagat

SEQ ID NO: 1883 - DNA, 21 bp, Artificial Sequence
  Synthetic Oligonucleotide
gaatttctacacagcgtagat

SEQ ID NO: 1884 - DNA, 21 bp, Artificial Sequence
  Synthetic Oligonucleotide
gaatttctactatgcgtagat

SEQ ID NO: 1885 - DNA, 21 bp, Artificial Sequence
  Synthetic Oligonucleotide
gaatttctactaagggtagat

SEQ ID NO: 1886 - DNA, 20 bp, Artificial Sequence
  Synthetic Oligonucleotide
caattatcgctcttgtggtt

SEQ ID NO: 1887 - DNA, 21 bp, Artificial Sequence
  Synthetic Oligonucleotide
caattgcctgtaagttgggct

SEQ ID NO: 1888 - DNA, 22 bp, Artificial Sequence
  Synthetic Oligonucleotide
gaatttctactgtctcgtagat

SEQ ID NO: 1889 - DNA, 21 bp, Artificial Sequence
  Synthetic Oligonucleotide
gaatttctccctcaaggagat

SEQ ID NO: 1890 - DNA, 20 bp, Artificial Sequence
  Synthetic Oligonucleotide
gaatttggcatctttgccgt

SEQ ID NO: 1891 - DNA, 21 bp, Artificial Sequence
  Synthetic Oligonucleotide
caatttctacataatgtagat

SEQ ID NO: 1892 - DNA, 22 bp, Artificial Sequence
  Synthetic Oligonucleotide
gaatttctactgtggtgtagat

SEQ ID NO: 1893 - DNA, 22 bp, Artificial Sequence
  Synthetic Oligonucleotide
gaatttctactctttcgtagat

SEQ ID NO: 1894 - DNA, 21 bp, Artificial Sequence
  Synthetic Oligonucleotide
gaatttctactattcgtagat

SEQ ID NO: 1895 - DNA, 22 bp, Artificial Sequence
  Synthetic Oligonucleotide
aaatttctactaatacgtagat

SEQ ID NO: 1896 - DNA, 20 bp, Artificial Sequence
  Synthetic Oligonucleotide
gaattcctgttcttgcaggt

SEQ ID NO: 1897 - DNA, 22 bp, Artificial Sequence
  Synthetic Oligonucleotide
caatttctacccacctgtagat

SEQ ID NO: 1898 - DNA, 22 bp, Artificial Sequence
  Synthetic Oligonucleotide
gaatttctacttgcatgtagat

SEQ ID NO: 1899 - DNA, 22 bp, Artificial Sequence
  Synthetic Oligonucleotide
gaatttctccatggcgggagat

SEQ ID NO: 1900 - DNA, 21 bp, Artificial Sequence
  Synthetic Oligonucleotide
caattgaggctaagtgcctct

SEQ ID NO: 1901 - DNA, 21 bp, Artificial Sequence
  Synthetic Oligonucleotide
aaatttctccacagcggagat

SEQ ID NO: 1902 - DNA, 22 bp, Artificial Sequence
  Synthetic Oligonucleotide
gaatttctactgtcccgtagat

SEQ ID NO: 1903 - DNA, 22 bp, Artificial Sequence
  Synthetic Oligonucleotide
aaatttctacccgtacgtagat

SEQ ID NO: 1904 - DNA, 22 bp, Artificial Sequence
  Synthetic Oligonucleotide
caatttctactaacgagtagat

SEQ ID NO: 1905 - DNA, 21 bp, Artificial Sequence
  Synthetic Oligonucleotide
caattctgtttaagtgatagt

SEQ ID NO: 1906 - DNA, 20 bp, Artificial Sequence
  Synthetic Oligonucleotide
gaattgtgtgtctttgtact

SEQ ID NO: 1907 - DNA, 20 bp, Artificial Sequence
  Synthetic Oligonucleotide
gaattcgtggtcttccgtgt

SEQ ID NO: 1908 - DNA, 21 bp, Artificial Sequence
  Synthetic Oligonucleotide
gaatttctcccgccaggagat

SEQ ID NO: 1909 - DNA, 22 bp, Artificial Sequence
  Synthetic Oligonucleotide
aaatttctccgctgctggagat

SEQ ID NO: 1910 - DNA, 21 bp, Artificial Sequence
  Synthetic Oligonucleotide
caatttctccctcagggagat

SEQ ID NO: 1911 - DNA, 22 bp, Artificial Sequence
  Synthetic Oligonucleotide
gaatttctactgtcatgtagat

SEQ ID NO: 1912 - DNA, 20 bp, Artificial Sequence
  Synthetic Oligonucleotide
gaatttctactgccgtagat

SEQ ID NO: 1913 - DNA, 20 bp, Artificial Sequence
  Synthetic Oligonucleotide
gaatttaccctcttgggtgt

SEQ ID NO: 1914 - DNA, 22 bp, Artificial Sequence
  Synthetic Oligonucleotide
gaatttctccgaccccggagat

SEQ ID NO: 1915 - DNA, 22 bp, Artificial Sequence
  Synthetic Oligonucleotide
gaatttctaccaaaaggtagat

SEQ ID NO: 1916 - DNA, 20 bp, Artificial Sequence
  Synthetic Oligonucleotide
aaatttctactctagtagat

SEQ ID NO: 1917 - DNA, 21 bp, Artificial Sequence
  Synthetic Oligonucleotide
gaatttctacttctagtagat

SEQ ID NO: 1918 - DNA, 21 bp, Artificial Sequence
  Synthetic Oligonucleotide
aaattcgtactaagtgtacgt

SEQ ID NO: 1919 - DNA, 20 bp, Artificial Sequence
  Synthetic Oligonucleotide
gaattgcggatctttctgtt

SEQ ID NO: 1920 - DNA, 21 bp, Artificial Sequence
  Synthetic Oligonucleotide
caatttctactggccgtagat

SEQ ID NO: 1921 - DNA, 20 bp, Artificial Sequence
  Synthetic Oligonucleotide
caatttgttctcttgagcgt

SEQ ID NO: 1922 - DNA, 21 bp, Artificial Sequence
  Synthetic Oligonucleotide
gaatttctactcgtcgtagat

SEQ ID NO: 1923 - DNA, 22 bp, Artificial Sequence
  Synthetic Oligonucleotide
gaatttctaccgaatagtagat

SEQ ID NO: 1924 - DNA, 21 bp, Artificial Sequence
  Synthetic Oligonucleotide
gaatttctactatgggtagat

SEQ ID NO: 1925 - DNA, 22 bp, Artificial Sequence
  Synthetic Oligonucleotide
gaatttctacttcgttgtagat

SEQ ID NO: 1926 - DNA, 22 bp, Artificial Sequence
  Synthetic Oligonucleotide
gaatttctactgctccgtagat

SEQ ID NO: 1927 - DNA, 20 bp, Artificial Sequence
  Synthetic Oligonucleotide
gaattgtcagtcttttggct

SEQ ID NO: 1928 - DNA, 22 bp, Artificial Sequence
  Synthetic Oligonucleotide
gaatttctcctcggccggagat

SEQ ID NO: 1929 - DNA, 22 bp, Artificial Sequence
  Synthetic Oligonucleotide
gaatttctccccgggaggagat

SEQ ID NO: 1930 - DNA, 21 bp, Artificial Sequence
  Synthetic Oligonucleotide
caatttctacttcccgtagat

SEQ ID NO: 1931 - DNA, 21 bp, Artificial Sequence
  Synthetic Oligonucleotide
caatttctaccatctgtagat

SEQ ID NO: 1932 - DNA, 22 bp, Artificial Sequence
  Synthetic Oligonucleotide
aaatttctactggcacgtagat

SEQ ID NO: 1933 - DNA, 22 bp, Artificial Sequence
  Synthetic Oligonucleotide
caatttctactggttcgtagat

SEQ ID NO: 1934 - DNA, 21 bp, Artificial Sequence
  Synthetic Oligonucleotide
caattgagtgtaagttactct

SEQ ID NO: 1935 - DNA, 22 bp, Artificial Sequence
  Synthetic Oligonucleotide
caatttctactttgttgtagat

SEQ ID NO: 1936 - DNA, 20 bp, Artificial Sequence
  Synthetic Oligonucleotide
caattagtggtctttcattt

SEQ ID NO: 1937 - DNA, 22 bp, Artificial Sequence
  Synthetic Oligonucleotide
aaatttctcccctcgcggagat

SEQ ID NO: 1938 - DNA, 21 bp, Artificial Sequence
  Synthetic Oligonucleotide
caatttctacttcctgtagat

SEQ ID NO: 1939 - DNA, 21 bp, Artificial Sequence
  Synthetic Oligonucleotide
gaatttctccgagtcggagat

SEQ ID NO: 1940 - DNA, 21 bp, Artificial Sequence
  Synthetic Oligonucleotide
caatttctactggacgtagat

SEQ ID NO: 1941 - DNA, 22 bp, Artificial Sequence
  Synthetic Oligonucleotide
gaatttctacttgtttgtagat

SEQ ID NO: 1942 - DNA, 22 bp, Artificial Sequence
  Synthetic Oligonucleotide
gaatttctactagttagtagat

SEQ ID NO: 1943 - DNA, 22 bp, Artificial Sequence
  Synthetic Oligonucleotide
gaatttctactacggcgtagat

SEQ ID NO: 1944 - DNA, 22 bp, Artificial Sequence
  Synthetic Oligonucleotide
gaatttctccatagcgggagat

SEQ ID NO: 1945 - DNA, 21 bp, Artificial Sequence
  Synthetic Oligonucleotide
caattgcttttaagtaaagct

SEQ ID NO: 1946 - DNA, 20 bp, Artificial Sequence
  Synthetic Oligonucleotide
caatttctcctaacggagat

SEQ ID NO: 1947 - DNA, 20 bp, Artificial Sequence
  Synthetic Oligonucleotide
gaattttaggtcttcctagt

SEQ ID NO: 1948 - DNA, 22 bp, Artificial Sequence
  Synthetic Oligonucleotide
caatttctccataagtggagat

SEQ ID NO: 1949 - DNA, 22 bp, Artificial Sequence
  Synthetic Oligonucleotide
caatttctactaagccgtagat

SEQ ID NO: 1950 - DNA, 22 bp, Artificial Sequence
  Synthetic Oligonucleotide
caatttctactgaaccgtagat

SEQ ID NO: 1951 - DNA, 21 bp, Artificial Sequence
  Synthetic Oligonucleotide
aaatttctcccatcgggagat

SEQ ID NO: 1952 - DNA, 21 bp, Artificial Sequence
  Synthetic Oligonucleotide
caatttgggctaagtgttcgt

SEQ ID NO: 1953 - DNA, 21 bp, Artificial Sequence
  Synthetic Oligonucleotide
gaatttctccgaacaggagat

SEQ ID NO: 1954 - DNA, 21 bp, Artificial Sequence
  Synthetic Oligonucleotide
gaatttctccacgtcggagat

SEQ ID NO: 1955 - DNA, 22 bp, Artificial Sequence
  Synthetic Oligonucleotide
caatttctccaagcacggagat

SEQ ID NO: 1956 - DNA, 21 bp, Artificial Sequence
  Synthetic Oligonucleotide
caatttctccgcacgggagat

SEQ ID NO: 1957 - DNA, 22 bp, Artificial Sequence
  Synthetic Oligonucleotide
caatttctccaaaggaggagat

SEQ ID NO: 1958 - DNA, 20 bp, Artificial Sequence
  Synthetic Oligonucleotide
caattagtggtcttccgctt

SEQ ID NO: 1959 - DNA, 22 bp, Artificial Sequence
  Synthetic Oligonucleotide
aaatttctactcattcgtagat

SEQ ID NO: 1960 - DNA, 21 bp, Artificial Sequence
  Synthetic Oligonucleotide
caatttctacacactgtagat

SEQ ID NO: 1961 - DNA, 22 bp, Artificial Sequence
  Synthetic Oligonucleotide
gaatttctcctatggcggagat

SEQ ID NO: 1962 - DNA, 21 bp, Artificial Sequence
  Synthetic Oligonucleotide
gaatttctccaacacggagat

SEQ ID NO: 1963 - DNA, 20 bp, Artificial Sequence
  Synthetic Oligonucleotide
caattcctactcttgtgggt

SEQ ID NO: 1964 - DNA, 22 bp, Artificial Sequence
  Synthetic Oligonucleotide
aaatttctactcgctcgtagat

SEQ ID NO: 1965 - DNA, 22 bp, Artificial Sequence
  Synthetic Oligonucleotide
aaatttctactcagaagtagat

SEQ ID NO: 1966 - DNA, 22 bp, Artificial Sequence
  Synthetic Oligonucleotide
gaatttctactggatagtagat

SEQ ID NO: 1967 - DNA, 20 bp, Artificial Sequence
  Synthetic Oligonucleotide
gaatttctactcgcgtagat

SEQ ID NO: 1968 - DNA, 22 bp, Artificial Sequence
  Synthetic Oligonucleotide
caatttctactaacttgtagat

SEQ ID NO: 1969 - DNA, 21 bp, Artificial Sequence
  Synthetic Oligonucleotide
gaatttctcctcgtgggagat

SEQ ID NO: 1970 - DNA, 22 bp, Artificial Sequence
  Synthetic Oligonucleotide
caatttctactaatgcgtagat

SEQ ID NO: 1971 - DNA, 21 bp, Artificial Sequence
  Synthetic Oligonucleotide
caattgtccttaagtggggct

SEQ ID NO: 1972 - DNA, 22 bp, Artificial Sequence
  Synthetic Oligonucleotide
caatttctacttctgcgtagat

SEQ ID NO: 1973 - DNA, 22 bp, Artificial Sequence
  Synthetic Oligonucleotide
gaatttctacggtatagtagat

SEQ ID NO: 1974 - DNA, 22 bp, Artificial Sequence
  Synthetic Oligonucleotide
gaatttctactacaatgtagat

SEQ ID NO: 1975 - DNA, 20 bp, Artificial Sequence
  Synthetic Oligonucleotide
gaattgtctatctttggact

SEQ ID NO: 1976 - DNA, 22 bp, Artificial Sequence
  Synthetic Oligonucleotide
gaatttctccctgcccggagat

SEQ ID NO: 1977 - DNA, 21 bp, Artificial Sequence
  Synthetic Oligonucleotide
caatttctacagctggtagat

SEQ ID NO: 1978 - DNA, 21 bp, Artificial Sequence
  Synthetic Oligonucleotide
aaatttctactgacagtagat

SEQ ID NO: 1979 - DNA, 20 bp, Artificial Sequence
  Synthetic Oligonucleotide
caatttctcccaccggagat

SEQ ID NO: 1980 - DNA, 20 bp, Artificial Sequence
  Synthetic Oligonucleotide
caattaatcgtcttcgattt

SEQ ID NO: 1981 - DNA, 22 bp, Artificial Sequence
  Synthetic Oligonucleotide
caatttctactgctccgtagat

SEQ ID NO: 1982 - DNA, 22 bp, Artificial Sequence
  Synthetic Oligonucleotide
caatttctccaagcccggagat

SEQ ID NO: 1983 - DNA, 21 bp, Artificial Sequence
  Synthetic Oligonucleotide
caatttgtgctaagtgcgcgt

SEQ ID NO: 1984 - DNA, 21 bp, Artificial Sequence
  Synthetic Oligonucleotide
aaatttctactgcctgtagat

SEQ ID NO: 1985 - DNA, 22 bp, Artificial Sequence
  Synthetic Oligonucleotide
aaatttctccagcggaggagat

SEQ ID NO: 1986 - DNA, 22 bp, Artificial Sequence
  Synthetic Oligonucleotide
gaatttctactcccccgtagat

SEQ ID NO: 1987 - DNA, 22 bp, Artificial Sequence
  Synthetic Oligonucleotide
gaatttctccaccgtcggagat

SEQ ID NO: 1988 - DNA, 20 bp, Artificial Sequence
  Synthetic Oligonucleotide
aaatttctcctgaaggagat

SEQ ID NO: 1989 - DNA, 22 bp, Artificial Sequence
  Synthetic Oligonucleotide
gaatttctacttggccgtagat

SEQ ID NO: 1990 - DNA, 21 bp, Artificial Sequence
  Synthetic Oligonucleotide
caatttctaccagtagtagat

SEQ ID NO: 1991 - DNA, 20 bp, Artificial Sequence
  Synthetic Oligonucleotide
caattgggactcttgtcctt

SEQ ID NO: 1992 - DNA, 20 bp, Artificial Sequence
  Synthetic Oligonucleotide
gaatttctacttaagtagat

SEQ ID NO: 1993 - DNA, 20 bp, Artificial Sequence
  Synthetic Oligonucleotide
gaatttctactttggtagat

SEQ ID NO: 1994 - DNA, 20 bp, Artificial Sequence
  Synthetic Oligonucleotide
caattcagcgtctttgttgt

SEQ ID NO: 1995 - DNA, 20 bp, Artificial Sequence
  Synthetic Oligonucleotide
caattgttgatcttttgatt

SEQ ID NO: 1996 - DNA, 22 bp, Artificial Sequence
  Synthetic Oligonucleotide
gaatttctactaatgagtagat

SEQ ID NO: 1997 - DNA, 21 bp, Artificial Sequence
  Synthetic Oligonucleotide
aaatttctactaccggtagat

SEQ ID NO: 1998 - DNA, 21 bp, Artificial Sequence
  Synthetic Oligonucleotide
aaatttctactcagcgtagat

SEQ ID NO: 1999 - DNA, 21 bp, Artificial Sequence
  Synthetic Oligonucleotide
gaatttctacttccggtagat

SEQ ID NO: 2000 - DNA, 22 bp, Artificial Sequence
  Synthetic Oligonucleotide
aaatttctcctgcttcggagat

SEQ ID NO: 2001 - DNA, 21 bp, Artificial Sequence
  Synthetic Oligonucleotide
caatttctcccggatggagat

SEQ ID NO: 2002 - DNA, 21 bp, Artificial Sequence
  Synthetic Oligonucleotide
gaatttctactagcggtagat

SEQ ID NO: 2003 - DNA, 20 bp, Artificial Sequence
  Synthetic Oligonucleotide
caattagggctcttgtcctt

SEQ ID NO: 2004 - DNA, 21 bp, Artificial Sequence
  Synthetic Oligonucleotide
aaatttctccgcgagggagat

SEQ ID NO: 2005 - DNA, 22 bp, Artificial Sequence
  Synthetic Oligonucleotide
caatttctactcttacgtagat

SEQ ID NO: 2006 - DNA, 21 bp, Artificial Sequence
  Synthetic Oligonucleotide
caatttctccctcgcggagat

SEQ ID NO: 2007 - DNA, 22 bp, Artificial Sequence
  Synthetic Oligonucleotide
caatttctccggtcacggagat

SEQ ID NO: 2008 - DNA, 22 bp, Artificial Sequence
  Synthetic Oligonucleotide
caatttctccgcaacgggagat

SEQ ID NO: 2009 - DNA, 21 bp, Artificial Sequence
  Synthetic Oligonucleotide
gaatttctccgacgcggagat

SEQ ID NO: 2010 - DNA, 21 bp, Artificial Sequence
  Synthetic Oligonucleotide
caattacggttaagtaccgtt

SEQ ID NO: 2011 - DNA, 22 bp, Artificial Sequence
  Synthetic Oligonucleotide
caatttctacctagtagtagat

SEQ ID NO: 2012 - DNA, 21 bp, Artificial Sequence
  Synthetic Oligonucleotide
caatttctccgccgcggagat

SEQ ID NO: 2013 - DNA, 22 bp, Artificial Sequence
  Synthetic Oligonucleotide
gaatttctaccagacggtagat

SEQ ID NO: 2014 - DNA, 22 bp, Artificial Sequence
  Synthetic Oligonucleotide
caatttctccaacaaaggagat

SEQ ID NO: 2015 - DNA, 20 bp, Artificial Sequence
  Synthetic Oligonucleotide
caatttctacttaagtagat

SEQ ID NO: 2016 - DNA, 21 bp, Artificial Sequence
  Synthetic Oligonucleotide
aaatttctacgcggagtagat

SEQ ID NO: 2017 - DNA, 22 bp, Artificial Sequence
  Synthetic Oligonucleotide
caatttctactattttgtagat

SEQ ID NO: 2018 - DNA, 22 bp, Artificial Sequence
  Synthetic Oligonucleotide
gaatttctaccccccagtagat

SEQ ID NO: 2019 - DNA, 22 bp, Artificial Sequence
  Synthetic Oligonucleotide
gaatttctactacaccgtagat

SEQ ID NO: 2020 - DNA, 22 bp, Artificial Sequence
  Synthetic Oligonucleotide
gaatttctccccccccggagat

SEQ ID NO: 2021 - DNA, 21 bp, Artificial Sequence
  Synthetic Oligonucleotide
caattgagtttaagtggtttt

SEQ ID NO: 2022 - DNA, 22 bp, Artificial Sequence
  Synthetic Oligonucleotide
gaatttctccgtcgtgggagat

SEQ ID NO: 2023 - DNA, 21 bp, Artificial Sequence
  Synthetic Oligonucleotide
caatttctactctgcgtagat

SEQ ID NO: 2024 - DNA, 21 bp, Artificial Sequence
  Synthetic Oligonucleotide
gaatttctactccaggtagat

SEQ ID NO: 2025 - DNA, 21 bp, Artificial Sequence
  Synthetic Oligonucleotide
caatttctccatcggggagat

SEQ ID NO: 2026 - DNA, 20 bp, Artificial Sequence
  Synthetic Oligonucleotide
gaatttctcctactggagat

SEQ ID NO: 2027 - DNA, 22 bp, Artificial Sequence
  Synthetic Oligonucleotide
aaatttctaccaaggagtagat

SEQ ID NO: 2028 - DNA, 22 bp, Artificial Sequence
  Synthetic Oligonucleotide
gaatttctactgcaccgtagat

SEQ ID NO: 2029 - DNA, 22 bp, Artificial Sequence
  Synthetic Oligonucleotide
caatttctccctggctggagat

SEQ ID NO: 2030 - DNA, 21 bp, Artificial Sequence
  Synthetic Oligonucleotide
caattttcgctaagtgcggat

SEQ ID NO: 2031 - DNA, 21 bp, Artificial Sequence
  Synthetic Oligonucleotide
caatttctactattggtagat

SEQ ID NO: 2032 - DNA, 22 bp, Artificial Sequence
  Synthetic Oligonucleotide
caatttctactacaccgtagat

SEQ ID NO: 2033 - DNA, 22 bp, Artificial Sequence
  Synthetic Oligonucleotide
caatttctcccaaatgggagat

SEQ ID NO: 2034 - DNA, 21 bp, Artificial Sequence
  Synthetic Oligonucleotide
aaatttctcccactaggagat

SEQ ID NO: 2035 - DNA, 22 bp, Artificial Sequence
  Synthetic Oligonucleotide
caatttctactacattgtagat

SEQ ID NO: 2036 - DNA, 22 bp, Artificial Sequence
  Synthetic Oligonucleotide
gaatttctactagtaagtagat

SEQ ID NO: 2037 - DNA, 21 bp, Artificial Sequence
  Synthetic Oligonucleotide
caatttctactgcccgtagat

SEQ ID NO: 2038 - DNA, 21 bp, Artificial Sequence
  Synthetic Oligonucleotide
gaatttctaccaaatgtagat

SEQ ID NO: 2039 - DNA, 22 bp, Artificial Sequence
  Synthetic Oligonucleotide
gaatttctactgagtcgtagat

SEQ ID NO: 2040 - DNA, 22 bp, Artificial Sequence
  Synthetic Oligonucleotide
caatttctactgcgtcgtagat

SEQ ID NO: 2041 - DNA, 22 bp, Artificial Sequence
  Synthetic Oligonucleotide
aaatttctactcccatgtagat

SEQ ID NO: 2042 - DNA, 22 bp, Artificial Sequence
  Synthetic Oligonucleotide
gaatttctacaagatagtagat

SEQ ID NO: 2043 - DNA, 20 bp, Artificial Sequence
  Synthetic Oligonucleotide
gaatttctccccctggagat

SEQ ID NO: 2044 - DNA, 20 bp, Artificial Sequence
  Synthetic Oligonucleotide
caatttctacggccgtagat

SEQ ID NO: 2045 - DNA, 20 bp, Artificial Sequence
  Synthetic Oligonucleotide
caattttttgtcttcaggat

SEQ ID NO: 2046 - DNA, 21 bp, Artificial Sequence
  Synthetic Oligonucleotide
caatttctactcccggtagat

SEQ ID NO: 2047 - DNA, 20 bp, Artificial Sequence
  Synthetic Oligonucleotide
caatttctcccaacggagat

SEQ ID NO: 2048 - DNA, 22 bp, Artificial Sequence
  Synthetic Oligonucleotide
caatttctactttctcgtagat

SEQ ID NO: 2049 - DNA, 22 bp, Artificial Sequence
  Synthetic Oligonucleotide
caatttctacgcctgagtagat

SEQ ID NO: 2050 - DNA, 20 bp, Artificial Sequence
  Synthetic Oligonucleotide
caattgtgtatctttgtact

SEQ ID NO: 2051 - DNA, 22 bp, Artificial Sequence
  Synthetic Oligonucleotide
caatttctactaacgtgtagat

SEQ ID NO: 2052 - DNA, 21 bp, Artificial Sequence
  Synthetic Oligonucleotide
aaatttctccgccgtggagat

SEQ ID NO: 2053 - DNA, 21 bp, Artificial Sequence
  Synthetic Oligonucleotide
aaatttctactccgtgtagat

SEQ ID NO: 2054 - DNA, 22 bp, Artificial Sequence
  Synthetic Oligonucleotide
gaatttctactctgaagtagat

SEQ ID NO: 2055 - DNA, 20 bp, Artificial Sequence
  Synthetic Oligonucleotide
gaatttctcctaatggagat

SEQ ID NO: 2056 - DNA, 22 bp, Artificial Sequence
  Synthetic Oligonucleotide
caatttctactaattcgtagat

SEQ ID NO: 2057 - DNA, 20 bp, Artificial Sequence
  Synthetic Oligonucleotide
gaatttctacttgcgtagat

SEQ ID NO: 2058 - DNA, 21 bp, Artificial Sequence
  Synthetic Oligonucleotide
caatttctaccccgagtagat

SEQ ID NO: 2059 - DNA, 22 bp, Artificial Sequence
  Synthetic Oligonucleotide
gaatttctacttcctcgtagat

SEQ ID NO: 2060 - DNA, 21 bp, Artificial Sequence
  Synthetic Oligonucleotide
gaatttctacttgtggtagat

SEQ ID NO: 2061 - DNA, 22 bp, Artificial Sequence
  Synthetic Oligonucleotide
gaatttctacttgccggtagat

SEQ ID NO: 2062 - DNA, 20 bp, Artificial Sequence
  Synthetic Oligonucleotide
gaatttctcctaacggagat

SEQ ID NO: 2063 - DNA, 20 bp, Artificial Sequence
  Synthetic Oligonucleotide
caatttctccagtgggagat

SEQ ID NO: 2064 - DNA, 20 bp, Artificial Sequence
  Synthetic Oligonucleotide
caattgctcgtctttgagtt

SEQ ID NO: 2065 - DNA, 20 bp, Artificial Sequence
  Synthetic Oligonucleotide
caattggctatctttggcct

SEQ ID NO: 2066 - DNA, 21 bp, Artificial Sequence
  Synthetic Oligonucleotide
caatttctcccgctgggagat

SEQ ID NO: 2067 - DNA, 22 bp, Artificial Sequence
  Synthetic Oligonucleotide
caatttctacttgtacgtagat

SEQ ID NO: 2068 - DNA, 21 bp, Artificial Sequence
  Synthetic Oligonucleotide
caatttctacactctgtagat

SEQ ID NO: 2069 - DNA, 21 bp, Artificial Sequence
  Synthetic Oligonucleotide
caatttctacacgtcgtagat

SEQ ID NO: 2070 - DNA, 22 bp, Artificial Sequence
  Synthetic Oligonucleotide
gaatttctcctgttgcggagat

SEQ ID NO: 2071 - DNA, 22 bp, Artificial Sequence
  Synthetic Oligonucleotide
caatttctacttgtctgtagat

SEQ ID NO: 2072 - DNA, 22 bp, Artificial Sequence
  Synthetic Oligonucleotide
aaatttctcccgcgtcggagat

SEQ ID NO: 2073 - DNA, 20 bp, Artificial Sequence
  Synthetic Oligonucleotide
gaatttctcctggaggagat

SEQ ID NO: 2074 - DNA, 21 bp, Artificial Sequence
  Synthetic Oligonucleotide
gaatttctactcgatgtagat

SEQ ID NO: 2075 - DNA, 22 bp, Artificial Sequence
  Synthetic Oligonucleotide
gaatttctactgcatagtagat

SEQ ID NO: 2076 - DNA, 22 bp, Artificial Sequence
  Synthetic Oligonucleotide
gaatttctacttcgaagtagat

SEQ ID NO: 2077 - DNA, 21 bp, Artificial Sequence
  Synthetic Oligonucleotide
gaatttctactcgcagtagat

SEQ ID NO: 2078 - DNA, 22 bp, Artificial Sequence
  Synthetic Oligonucleotide
caatttctccggagcgggagat

SEQ ID NO: 2079 - DNA, 22 bp, Artificial Sequence
  Synthetic Oligonucleotide
caatttctcccacgatggagat

SEQ ID NO: 2080 - DNA, 22 bp, Artificial Sequence
  Synthetic Oligonucleotide
gaatttctcccgctcgggagat

SEQ ID NO: 2081 - DNA, 20 bp, Artificial Sequence
  Synthetic Oligonucleotide
caatttagcgtctttgttgt

SEQ ID NO: 2082 - DNA, 20 bp, Artificial Sequence
  Synthetic Oligonucleotide
caattgcgtgtctttgcgct

SEQ ID NO: 2083 - DNA, 20 bp, Artificial Sequence
  Synthetic Oligonucleotide
caattaacgctcttgcgttt

SEQ ID NO: 2084 - DNA, 22 bp, Artificial Sequence
  Synthetic Oligonucleotide
gaatttctactaactggtagat

SEQ ID NO: 2085 - DNA, 20 bp, Artificial Sequence
  Synthetic Oligonucleotide
caatttaccctcttgggtgt

SEQ ID NO: 2086 - DNA, 22 bp, Artificial Sequence
  Synthetic Oligonucleotide
caatttctcccgcctgggagat

SEQ ID NO: 2087 - DNA, 21 bp, Artificial Sequence
  Synthetic Oligonucleotide
gaatttctactgggagtagat

SEQ ID NO: 2088 - DNA, 20 bp, Artificial Sequence
  Synthetic Oligonucleotide
caattctgaatcttttcggt

SEQ ID NO: 2089 - DNA, 22 bp, Artificial Sequence
  Synthetic Oligonucleotide
caatttctcccgcgctggagat

SEQ ID NO: 2090 - DNA, 21 bp, Artificial Sequence
  Synthetic Oligonucleotide
caatttctacatagtgtagat

SEQ ID NO: 2091 - DNA, 22 bp, Artificial Sequence
  Synthetic Oligonucleotide
caatttctactagaccgtagat

SEQ ID NO: 2092 - DNA, 21 bp, Artificial Sequence
  Synthetic Oligonucleotide
caatttctactcgacgtagat

SEQ ID NO: 2093 - DNA, 22 bp, Artificial Sequence
  Synthetic Oligonucleotide
aaatttctacttactcgtagat

SEQ ID NO: 2094 - DNA, 21 bp, Artificial Sequence
  Synthetic Oligonucleotide
gaatttctaccgtacgtagat

SEQ ID NO: 2095 - DNA, 21 bp, Artificial Sequence
  Synthetic Oligonucleotide
gaatttctactgcgcgtagat

SEQ ID NO: 2096 - DNA, 21 bp, Artificial Sequence
  Synthetic Oligonucleotide
caatttctccacaagggagat

SEQ ID NO: 2097 - DNA, 20 bp, Artificial Sequence
  Synthetic Oligonucleotide
gaatttctacggtcgtagat

SEQ ID NO: 2098 - DNA, 20 bp, Artificial Sequence
  Synthetic Oligonucleotide
caattaccgctcttgtggtt

SEQ ID NO: 2099 - DNA, 20 bp, Artificial Sequence
  Synthetic Oligonucleotide
caattcgtgttcttacatgt

SEQ ID NO: 2100 - DNA, 22 bp, Artificial Sequence
  Synthetic Oligonucleotide
caatttctacttgtccgtagat

SEQ ID NO: 2101 - DNA, 22 bp, Artificial Sequence
  Synthetic Oligonucleotide
gaatttctacggtcgcgtagat

SEQ ID NO: 2102 - DNA, 22 bp, Artificial Sequence
  Synthetic Oligonucleotide
aaatttctactgtgatgtagat

SEQ ID NO: 2103 - DNA, 22 bp, Artificial Sequence
  Synthetic Oligonucleotide
caatttctccgttagcggagat

SEQ ID NO: 2104 - DNA, 21 bp, Artificial Sequence
  Synthetic Oligonucleotide
caatttctacttgtagtagat

SEQ ID NO: 2105 - DNA, 22 bp, Artificial Sequence
  Synthetic Oligonucleotide
gaatttctactttcgcgtagat

SEQ ID NO: 2106 - DNA, 22 bp, Artificial Sequence
  Synthetic Oligonucleotide
gaatttctacttcagtgtagat

SEQ ID NO: 2107 - DNA, 22 bp, Artificial Sequence
  Synthetic Oligonucleotide
aaatttctactcagatgtagat

SEQ ID NO: 2108 - DNA, 20 bp, Artificial Sequence
  Synthetic Oligonucleotide
aaatttctcccctgggagat

SEQ ID NO: 2109 - DNA, 21 bp, Artificial Sequence
  Synthetic Oligonucleotide
caatttctccgcccaggagat

SEQ ID NO: 2110 - DNA, 22 bp, Artificial Sequence
  Synthetic Oligonucleotide
aaatttctaccagttagtagat

SEQ ID NO: 2111 - DNA, 20 bp, Artificial Sequence
  Synthetic Oligonucleotide
caattcaggttcttacctgt

SEQ ID NO: 2112 - DNA, 22 bp, Artificial Sequence
  Synthetic Oligonucleotide
caatttctacgggagcgtagat

SEQ ID NO: 2113 - DNA, 22 bp, Artificial Sequence
  Synthetic Oligonucleotide
gaatttctactctcacgtagat

SEQ ID NO: 2114 - DNA, 22 bp, Artificial Sequence
  Synthetic Oligonucleotide
caatttctacctccaagtagat

SEQ ID NO: 2115 - DNA, 20 bp, Artificial Sequence
  Synthetic Oligonucleotide
caattcttagtcttttgggt

SEQ ID NO: 2116 - DNA, 22 bp, Artificial Sequence
  Synthetic Oligonucleotide
gaatttctccgcgcgtggagat

SEQ ID NO: 2117 - DNA, 21 bp, Artificial Sequence
  Synthetic Oligonucleotide
caattcggtttaagtgattgt

SEQ ID NO: 2118 - DNA, 20 bp, Artificial Sequence
  Synthetic Oligonucleotide
aaattggctatctttggctt

SEQ ID NO: 2119 - DNA, 21 bp, Artificial Sequence
  Synthetic Oligonucleotide
caatttctccaacgtggagat

SEQ ID NO: 2120 - DNA, 22 bp, Artificial Sequence
  Synthetic Oligonucleotide
gaatttctactacgttgtagat

SEQ ID NO: 2121 - DNA, 20 bp, Artificial Sequence
  Synthetic Oligonucleotide
caatttctactggcgtagat

SEQ ID NO: 2122 - DNA, 20 bp, Artificial Sequence
  Synthetic Oligonucleotide
aaatttctacttgtgtagat

SEQ ID NO: 2123 - DNA, 22 bp, Artificial Sequence
  Synthetic Oligonucleotide
gaatttctcccgcagcggagat

SEQ ID NO: 2124 - DNA, 22 bp, Artificial Sequence
  Synthetic Oligonucleotide
gaatttctccccctggggagat

SEQ ID NO: 2125 - DNA, 22 bp, Artificial Sequence
  Synthetic Oligonucleotide
caatttctcctgtacaggagat

SEQ ID NO: 2126 - DNA, 22 bp, Artificial Sequence
  Synthetic Oligonucleotide
gaatttctactagtccgtagat

SEQ ID NO: 2127 - DNA, 21 bp, Artificial Sequence
  Synthetic Oligonucleotide
aaatttctactcactgtagat

SEQ ID NO: 2128 - DNA, 22 bp, Artificial Sequence
  Synthetic Oligonucleotide
aaatttctccgatgacggagat

SEQ ID NO: 2129 - DNA, 22 bp, Artificial Sequence
  Synthetic Oligonucleotide
gaatttctactatttagtagat

SEQ ID NO: 2130 - DNA, 22 bp, Artificial Sequence
  Synthetic Oligonucleotide
caatttctcctgctacggagat

SEQ ID NO: 2131 - DNA, 22 bp, Artificial Sequence
  Synthetic Oligonucleotide
caatttctacgtccgcgtagat

SEQ ID NO: 2132 - DNA, 22 bp, Artificial Sequence
  Synthetic Oligonucleotide
caatttctactagactgtagat

SEQ ID NO: 2133 - DNA, 22 bp, Artificial Sequence
  Synthetic Oligonucleotide
caatttctactctaatgtagat

SEQ ID NO: 2134 - DNA, 20 bp, Artificial Sequence
  Synthetic Oligonucleotide
caattagcagtcttctgctt

SEQ ID NO: 2135 - DNA, 22 bp, Artificial Sequence
  Synthetic Oligonucleotide
caatttctcccagtgaggagat

SEQ ID NO: 2136 - DNA, 20 bp, Artificial Sequence
  Synthetic Oligonucleotide
caattgctcttcttagggct

SEQ ID NO: 2137 - DNA, 21 bp, Artificial Sequence
  Synthetic Oligonucleotide
caatttctactcagagtagat

SEQ ID NO: 2138 - DNA, 21 bp, Artificial Sequence
  Synthetic Oligonucleotide
caatttctactgtgagtagat

SEQ ID NO: 2139 - DNA, 20 bp, Artificial Sequence
  Synthetic Oligonucleotide
aaatttctactcatgtagat

SEQ ID NO: 2140 - DNA, 21 bp, Artificial Sequence
  Synthetic Oligonucleotide
caatttctaccctacgtagat

SEQ ID NO: 2141 - DNA, 20 bp, Artificial Sequence
  Synthetic Oligonucleotide
caattggttgtcttcggctt

SEQ ID NO: 2142 - DNA, 20 bp, Artificial Sequence
  Synthetic Oligonucleotide
caattcttgttcttgcgagt

SEQ ID NO: 2143 - DNA, 20 bp, Artificial Sequence
  Synthetic Oligonucleotide
gaatttctactttcgtagat

SEQ ID NO: 2144 - DNA, 21 bp, Artificial Sequence
  Synthetic Oligonucleotide
gaatttctacttcaggtagat

SEQ ID NO: 2145 - DNA, 22 bp, Artificial Sequence
  Synthetic Oligonucleotide
gaatttctactttgacgtagat

SEQ ID NO: 2146 - DNA, 22 bp, Artificial Sequence
  Synthetic Oligonucleotide
gaatttctccacttcgggagat

SEQ ID NO: 2147 - DNA, 21 bp, Artificial Sequence
  Synthetic Oligonucleotide
aaatttctacgagccgtagat

SEQ ID NO: 2148 - DNA, 20 bp, Artificial Sequence
  Synthetic Oligonucleotide
aaattggttgtcttcggctt

SEQ ID NO: 2149 - DNA, 21 bp, Artificial Sequence
  Synthetic Oligonucleotide
gaatttctacccgcagtagat

SEQ ID NO: 2150 - DNA, 20 bp, Artificial Sequence
  Synthetic Oligonucleotide
caattttgaatcttttcagt

SEQ ID NO: 2151 - DNA, 21 bp, Artificial Sequence
  Synthetic Oligonucleotide
gaatttctactgcctgtagat

SEQ ID NO: 2152 - DNA, 20 bp, Artificial Sequence
  Synthetic Oligonucleotide
caatttcgcgtcttcgtggt

SEQ ID NO: 2153 - DNA, 21 bp, Artificial Sequence
  Synthetic Oligonucleotide
gaatttctacttatcgtagat

SEQ ID NO: 2154 - DNA, 20 bp, Artificial Sequence
  Synthetic Oligonucleotide
gaatttgttctcttgagcgt

SEQ ID NO: 2155 - DNA, 22 bp, Artificial Sequence
  Synthetic Oligonucleotide
gaatttctccgagaacggagat

SEQ ID NO: 2156 - DNA, 22 bp, Artificial Sequence
  Synthetic Oligonucleotide
caatttctaccctacggtagat

SEQ ID NO: 2157 - DNA, 22 bp, Artificial Sequence
  Synthetic Oligonucleotide
gaatttctcctacgccggagat

SEQ ID NO: 2158 - DNA, 22 bp, Artificial Sequence
  Synthetic Oligonucleotide
caatttctacagattagtagat

SEQ ID NO: 2159 - DNA, 22 bp, Artificial Sequence
  Synthetic Oligonucleotide
caatttctactcctgcgtagat

SEQ ID NO: 2160 - DNA, 22 bp, Artificial Sequence
  Synthetic Oligonucleotide
gaatttctaccaattagtagat

SEQ ID NO: 2161 - DNA, 22 bp, Artificial Sequence
  Synthetic Oligonucleotide
caatttctcctgcgggggagat

SEQ ID NO: 2162 - DNA, 22 bp, Artificial Sequence
  Synthetic Oligonucleotide
caatttctacctctctgtagat

SEQ ID NO: 2163 - DNA, 22 bp, Artificial Sequence
  Synthetic Oligonucleotide
gaatttctacttactagtagat

SEQ ID NO: 2164 - DNA, 22 bp, Artificial Sequence
  Synthetic Oligonucleotide
caatttctacccctgcgtagat

SEQ ID NO: 2165 - DNA, 22 bp, Artificial Sequence
  Synthetic Oligonucleotide
caatttctcctcgaacggagat

SEQ ID NO: 2166 - DNA, 22 bp, Artificial Sequence
  Synthetic Oligonucleotide
caatttctacgaaagtgtagat

SEQ ID NO: 2167 - DNA, 20 bp, Artificial Sequence
  Synthetic Oligonucleotide
caattagtgctcttgcattt

SEQ ID NO: 2168 - DNA, 22 bp, Artificial Sequence
  Synthetic Oligonucleotide
aaatttctacccactcgtagat

SEQ ID NO: 2169 - DNA, 22 bp, Artificial Sequence
  Synthetic Oligonucleotide
caatttctccatccgaggagat

SEQ ID NO: 2170 - DNA, 20 bp, Artificial Sequence
  Synthetic Oligonucleotide
gaattgctgctcttgcggct

SEQ ID NO: 2171 - DNA, 21 bp, Artificial Sequence
  Synthetic Oligonucleotide
caatttctccgtaacggagat

SEQ ID NO: 2172 - DNA, 22 bp, Artificial Sequence
  Synthetic Oligonucleotide
gaatttctccccacttggagat

SEQ ID NO: 2173 - DNA, 21 bp, Artificial Sequence
  Synthetic Oligonucleotide
gaatttctactgtgagtagat

SEQ ID NO: 2174 - DNA, 21 bp, Artificial Sequence
  Synthetic Oligonucleotide
caatttctactgcacgtagat

SEQ ID NO: 2175 - DNA, 20 bp, Artificial Sequence
  Synthetic Oligonucleotide
caattaatgatctttcgttt

SEQ ID NO: 2176 - DNA, 21 bp, Artificial Sequence
  Synthetic Oligonucleotide
caattactagtaagtctggtt

SEQ ID NO: 2177 - DNA, 20 bp, Artificial Sequence
  Synthetic Oligonucleotide
caatttctacctgtgtagat

SEQ ID NO: 2178 - DNA, 21 bp, Artificial Sequence
  Synthetic Oligonucleotide
caattacgtgtaagtcgcgtt

SEQ ID NO: 2179 - DNA, 21 bp, Artificial Sequence
  Synthetic Oligonucleotide
caatttctcctaccgggagat

SEQ ID NO: 2180 - DNA, 22 bp, Artificial Sequence
  Synthetic Oligonucleotide
caatttctacactcgcgtagat

SEQ ID NO: 2181 - DNA, 20 bp, Artificial Sequence
  Synthetic Oligonucleotide
gaatttctacttgagtagat

SEQ ID NO: 2182 - DNA, 22 bp, Artificial Sequence
  Synthetic Oligonucleotide
gaatttctactcagccgtagat

SEQ ID NO: 2183 - DNA, 21 bp, Artificial Sequence
  Synthetic Oligonucleotide
caatttctactccatgtagat

SEQ ID NO: 2184 - DNA, 21 bp, Artificial Sequence
  Synthetic Oligonucleotide
caatttctccaggaaggagat

SEQ ID NO: 2185 - DNA, 21 bp, Artificial Sequence
  Synthetic Oligonucleotide
caattgtttgtaagtcgaact

SEQ ID NO: 2186 - DNA, 21 bp, Artificial Sequence
  Synthetic Oligonucleotide
caatttctacgggaagtagat

SEQ ID NO: 2187 - DNA, 20 bp, Artificial Sequence
  Synthetic Oligonucleotide
caatttctacaacggtagat

SEQ ID NO: 2188 - DNA, 21 bp, Artificial Sequence
  Synthetic Oligonucleotide
gaatttctccgcgccggagat

SEQ ID NO: 2189 - DNA, 22 bp, Artificial Sequence
  Synthetic Oligonucleotide
gaatttctacccgaccgtagat

SEQ ID NO: 2190 - DNA, 21 bp, Artificial Sequence
  Synthetic Oligonucleotide
caatttctactgttcgtagat

SEQ ID NO: 2191 - DNA, 21 bp, Artificial Sequence
  Synthetic Oligonucleotide
caatttctacttaacgtagat

SEQ ID NO: 2192 - DNA, 21 bp, Artificial Sequence
  Synthetic Oligonucleotide
gaatttctccatatgggagat

SEQ ID NO: 2193 - DNA, 22 bp, Artificial Sequence
  Synthetic Oligonucleotide
gaatttctccctagcgggagat

SEQ ID NO: 2194 - DNA, 22 bp, Artificial Sequence
  Synthetic Oligonucleotide
caatttctacgactcagtagat

SEQ ID NO: 2195 - DNA, 22 bp, Artificial Sequence
  Synthetic Oligonucleotide
caatttctccagcataggagat

SEQ ID NO: 2196 - DNA, 22 bp, Artificial Sequence
  Synthetic Oligonucleotide
gaatttctccgcgaatggagat

SEQ ID NO: 2197 - DNA, 22 bp, Artificial Sequence
  Synthetic Oligonucleotide
gaatttctacgtcgcagtagat

SEQ ID NO: 2198 - DNA, 22 bp, Artificial Sequence
  Synthetic Oligonucleotide
caatttctaccagctagtagat

SEQ ID NO: 2199 - DNA, 22 bp, Artificial Sequence
  Synthetic Oligonucleotide
caatttctactgttctgtagat

SEQ ID NO: 2200 - DNA, 22 bp, Artificial Sequence
  Synthetic Oligonucleotide
caatttctcctgagttggagat

SEQ ID NO: 2201 - DNA, 22 bp, Artificial Sequence
  Synthetic Oligonucleotide
gaatttctacgtacgagtagat

SEQ ID NO: 2202 - DNA, 21 bp, Artificial Sequence
  Synthetic Oligonucleotide
caatttaggttaagtgcttat

SEQ ID NO: 2203 - DNA, 22 bp, Artificial Sequence
  Synthetic Oligonucleotide
gaatttctaccaataagtagat

SEQ ID NO: 2204 - DNA, 20 bp, Artificial Sequence
  Synthetic Oligonucleotide
aaatttctaccatcgtagat

SEQ ID NO: 2205 - DNA, 22 bp, Artificial Sequence
  Synthetic Oligonucleotide
gaatttctcctgaagcggagat

SEQ ID NO: 2206 - DNA, 22 bp, Artificial Sequence
  Synthetic Oligonucleotide
gaatttctacaggcgagtagat

SEQ ID NO: 2207 - DNA, 22 bp, Artificial Sequence
  Synthetic Oligonucleotide
caatttctactggtctgtagat

SEQ ID NO: 2208 - DNA, 22 bp, Artificial Sequence
  Synthetic Oligonucleotide
caatttctactaaagcgtagat

SEQ ID NO: 2209 - DNA, 22 bp, Artificial Sequence
  Synthetic Oligonucleotide
caatttctaccagcgtgtagat

SEQ ID NO: 2210 - DNA, 21 bp, Artificial Sequence
  Synthetic Oligonucleotide
caattgtgtttaagtggcact

SEQ ID NO: 2211 - DNA, 22 bp, Artificial Sequence
  Synthetic Oligonucleotide
caatttctcctgccagggagat

SEQ ID NO: 2212 - DNA, 21 bp, Artificial Sequence
  Synthetic Oligonucleotide
gaatttctactgcacgtagat

SEQ ID NO: 2213 - DNA, 21 bp, Artificial Sequence
  Synthetic Oligonucleotide
aaatttctactcgcagtagat

SEQ ID NO: 2214 - DNA, 21 bp, Artificial Sequence
  Synthetic Oligonucleotide
caattgttagtaagtctagct

SEQ ID NO: 2215 - DNA, 22 bp, Artificial Sequence
  Synthetic Oligonucleotide
aaatttctactgcgacgtagat

SEQ ID NO: 2216 - DNA, 22 bp, Artificial Sequence
  Synthetic Oligonucleotide
gaatttctactcacatgtagat

SEQ ID NO: 2217 - DNA, 22 bp, Artificial Sequence
  Synthetic Oligonucleotide
caatttctaccggtgcgtagat

SEQ ID NO: 2218 - DNA, 22 bp, Artificial Sequence
  Synthetic Oligonucleotide
gaatttctacgagctggtagat

SEQ ID NO: 2219 - DNA, 22 bp, Artificial Sequence
  Synthetic Oligonucleotide
caatttctactaacatgtagat

SEQ ID NO: 2220 - DNA, 22 bp, Artificial Sequence
  Synthetic Oligonucleotide
gaatttctactggggcgtagat

SEQ ID NO: 2221 - DNA, 20 bp, Artificial Sequence
  Synthetic Oligonucleotide
caatttatggtcttctgtat

SEQ ID NO: 2222 - DNA, 22 bp, Artificial Sequence
  Synthetic Oligonucleotide
caatttctcccaccctggagat

SEQ ID NO: 2223 - DNA, 22 bp, Artificial Sequence
  Synthetic Oligonucleotide
caatttctcccagatcggagat

SEQ ID NO: 2224 - DNA, 21 bp, Artificial Sequence
  Synthetic Oligonucleotide
gaatttctcccagatggagat

SEQ ID NO: 2225 - DNA, 22 bp, Artificial Sequence
  Synthetic Oligonucleotide
caatttctactatcccgtagat

SEQ ID NO: 2226 - DNA, 22 bp, Artificial Sequence
  Synthetic Oligonucleotide
gaatttctacttcgatgtagat

SEQ ID NO: 2227 - DNA, 22 bp, Artificial Sequence
  Synthetic Oligonucleotide
caatttctacttagccgtagat

SEQ ID NO: 2228 - DNA, 20 bp, Artificial Sequence
  Synthetic Oligonucleotide
caatttctcctgtcggagat

SEQ ID NO: 2229 - DNA, 22 bp, Artificial Sequence
  Synthetic Oligonucleotide
caatttctacaacaaagtagat

SEQ ID NO: 2230 - DNA, 22 bp, Artificial Sequence
  Synthetic Oligonucleotide
gaatttctactccctcgtagat

SEQ ID NO: 2231 - DNA, 22 bp, Artificial Sequence
  Synthetic Oligonucleotide
gaatttctactcgcctgtagat

SEQ ID NO: 2232 - DNA, 21 bp, Artificial Sequence
  Synthetic Oligonucleotide
caatttttgctaagtgtaggt

SEQ ID NO: 2233 - DNA, 22 bp, Artificial Sequence
  Synthetic Oligonucleotide
aaatttctccgaaccaggagat

SEQ ID NO: 2234 - DNA, 22 bp, Artificial Sequence
  Synthetic Oligonucleotide
caatttctcccacaatggagat

SEQ ID NO: 2235 - DNA, 20 bp, Artificial Sequence
  Synthetic Oligonucleotide
caattctgaatcttttcagt

SEQ ID NO: 2236 - DNA, 22 bp, Artificial Sequence
  Synthetic Oligonucleotide
caatttctacttgcctgtagat

SEQ ID NO: 2237 - DNA, 20 bp, Artificial Sequence
  Synthetic Oligonucleotide
caattgtgtgtcttcgtact

SEQ ID NO: 2238 - DNA, 22 bp, Artificial Sequence
  Synthetic Oligonucleotide
aaatttctactcactcgtagat

SEQ ID NO: 2239 - DNA, 21 bp, Artificial Sequence
  Synthetic Oligonucleotide
caatttctacaatgtgtagat

SEQ ID NO: 2240 - DNA, 22 bp, Artificial Sequence
  Synthetic Oligonucleotide
gaatttctccgaacgaggagat

SEQ ID NO: 2241 - DNA, 22 bp, Artificial Sequence
  Synthetic Oligonucleotide
caatttctactcattagtagat

SEQ ID NO: 2242 - DNA, 22 bp, Artificial Sequence
  Synthetic Oligonucleotide
gaatttctacaagtgcgtagat

SEQ ID NO: 2243 - DNA, 21 bp, Artificial Sequence
  Synthetic Oligonucleotide
caattggcgttaagtacgtct

SEQ ID NO: 2244 - DNA, 21 bp, Artificial Sequence
  Synthetic Oligonucleotide
caatttctacaggtcgtagat

SEQ ID NO: 2245 - DNA, 22 bp, Artificial Sequence
  Synthetic Oligonucleotide
gaatttctacttgcacgtagat

SEQ ID NO: 2246 - DNA, 22 bp, Artificial Sequence
  Synthetic Oligonucleotide
gaatttctactggcgcgtagat

SEQ ID NO: 2247 - DNA, 22 bp, Artificial Sequence
  Synthetic Oligonucleotide
caatttctacctcctcgtagat

SEQ ID NO: 2248 - DNA, 22 bp, Artificial Sequence
  Synthetic Oligonucleotide
aaatttctccccccggggagat

SEQ ID NO: 2249 - DNA, 20 bp, Artificial Sequence
  Synthetic Oligonucleotide
caatttctaccgatgtagat

SEQ ID NO: 2250 - DNA, 21 bp, Artificial Sequence
  Synthetic Oligonucleotide
gaatttctactgagtgtagat

SEQ ID NO: 2251 - DNA, 22 bp, Artificial Sequence
  Synthetic Oligonucleotide
gaatttctccaaagggggagat

SEQ ID NO: 2252 - DNA, 22 bp, Artificial Sequence
  Synthetic Oligonucleotide
caatttctactttatcgtagat

SEQ ID NO: 2253 - DNA, 22 bp, Artificial Sequence
  Synthetic Oligonucleotide
caatttctacgactacgtagat

SEQ ID NO: 2254 - DNA, 22 bp, Artificial Sequence
  Synthetic Oligonucleotide
caatttctcccccaacggagat

SEQ ID NO: 2255 - DNA, 20 bp, Artificial Sequence
  Synthetic Oligonucleotide
gaatttctacaggagtagat

SEQ ID NO: 2256 - DNA, 20 bp, Artificial Sequence
  Synthetic Oligonucleotide
caatttctccccctggagat

SEQ ID NO: 2257 - DNA, 20 bp, Artificial Sequence
  Synthetic Oligonucleotide
caatttcgtttcttggcggt

SEQ ID NO: 2258 - DNA, 20 bp, Artificial Sequence
  Synthetic Oligonucleotide
caatttctccctttggagat

SEQ ID NO: 2259 - DNA, 22 bp, Artificial Sequence
  Synthetic Oligonucleotide
caatttctacttgcacgtagat

SEQ ID NO: 2260 - DNA, 22 bp, Artificial Sequence
  Synthetic Oligonucleotide
caatttctacttggacgtagat

SEQ ID NO: 2261 - DNA, 21 bp, Artificial Sequence
  Synthetic Oligonucleotide
aaatttctacaagtcgtagat

SEQ ID NO: 2262 - DNA, 21 bp, Artificial Sequence
  Synthetic Oligonucleotide
caattgttggtaagtttgatt

SEQ ID NO: 2263 - DNA, 22 bp, Artificial Sequence
  Synthetic Oligonucleotide
caatttctacttctttgtagat

SEQ ID NO: 2264 - DNA, 22 bp, Artificial Sequence
  Synthetic Oligonucleotide
gaatttctactcatgtgtagat

SEQ ID NO: 2265 - DNA, 20 bp, Artificial Sequence
  Synthetic Oligonucleotide
caatttctcctagaggagat

SEQ ID NO: 2266 - DNA, 22 bp, Artificial Sequence
  Synthetic Oligonucleotide
gaatttctcctggcaaggagat

SEQ ID NO: 2267 - DNA, 22 bp, Artificial Sequence
  Synthetic Oligonucleotide
gaatttctactccatcgtagat

SEQ ID NO: 2268 - DNA, 21 bp, Artificial Sequence
  Synthetic Oligonucleotide
aaatttctaccccatgtagat

SEQ ID NO: 2269 - DNA, 22 bp, Artificial Sequence
  Synthetic Oligonucleotide
caatttctccggtcaaggagat

SEQ ID NO: 2270 - DNA, 22 bp, Artificial Sequence
  Synthetic Oligonucleotide
gaatttctccctcagcggagat

SEQ ID NO: 2271 - DNA, 22 bp, Artificial Sequence
  Synthetic Oligonucleotide
gaatttctccctcgaaggagat

SEQ ID NO: 2272 - DNA, 22 bp, Artificial Sequence
  Synthetic Oligonucleotide
gaatttctactacatggtagat

SEQ ID NO: 2273 - DNA, 22 bp, Artificial Sequence
  Synthetic Oligonucleotide
caatttctaccaacgagtagat

SEQ ID NO: 2274 - DNA, 22 bp, Artificial Sequence
  Synthetic Oligonucleotide
gaatttctactttcaagtagat

SEQ ID NO: 2275 - DNA, 22 bp, Artificial Sequence
  Synthetic Oligonucleotide
gaatttctactgccgcgtagat

SEQ ID NO: 2276 - DNA, 22 bp, Artificial Sequence
  Synthetic Oligonucleotide
gaatttctactagttggtagat

SEQ ID NO: 2277 - DNA, 22 bp, Artificial Sequence
  Synthetic Oligonucleotide
caatttctacacatatgtagat

SEQ ID NO: 2278 - DNA, 21 bp, Artificial Sequence
  Synthetic Oligonucleotide
caatttctacctgtcgtagat

SEQ ID NO: 2279 - DNA, 20 bp, Artificial Sequence
  Synthetic Oligonucleotide
caatttgcggtctttcgtgt

SEQ ID NO: 2280 - DNA, 21 bp, Artificial Sequence
  Synthetic Oligonucleotide
caatttctactaattgtagat

SEQ ID NO: 2281 - DNA, 21 bp, Artificial Sequence
  Synthetic Oligonucleotide
gaatttctactaatggtagat

SEQ ID NO: 2282 - DNA, 22 bp, Artificial Sequence
  Synthetic Oligonucleotide
caatttctacttaagcgtagat

SEQ ID NO: 2283 - DNA, 20 bp, Artificial Sequence
  Synthetic Oligonucleotide
caattgggattcttgtccct

SEQ ID NO: 2284 - DNA, 22 bp, Artificial Sequence
  Synthetic Oligonucleotide
caatttctacttctccgtagat

SEQ ID NO: 2285 - DNA, 22 bp, Artificial Sequence
  Synthetic Oligonucleotide
caatttctcccccgacggagat

SEQ ID NO: 2286 - DNA, 20 bp, Artificial Sequence
  Synthetic Oligonucleotide
caatttctcctactggagat

SEQ ID NO: 2287 - DNA, 20 bp, Artificial Sequence
  Synthetic Oligonucleotide
caatttgttctcttgggtgt

SEQ ID NO: 2288 - DNA, 22 bp, Artificial Sequence
  Synthetic Oligonucleotide
aaatttctccgctgacggagat

SEQ ID NO: 2289 - DNA, 22 bp, Artificial Sequence
  Synthetic Oligonucleotide
gaatttctacgacgtcgtagat

SEQ ID NO: 2290 - DNA, 20 bp, Artificial Sequence
  Synthetic Oligonucleotide
caattggaggtcttctttct

SEQ ID NO: 2291 - DNA, 22 bp, Artificial Sequence
  Synthetic Oligonucleotide
gaatttctacttttatgtagat

SEQ ID NO: 2292 - DNA, 22 bp, Artificial Sequence
  Synthetic Oligonucleotide
caatttctcctgcaccggagat

SEQ ID NO: 2293 - DNA, 22 bp, Artificial Sequence
  Synthetic Oligonucleotide
gaatttctacccttatgtagat

SEQ ID NO: 2294 - DNA, 22 bp, Artificial Sequence
  Synthetic Oligonucleotide
caatttctactatatcgtagat

SEQ ID NO: 2295 - DNA, 22 bp, Artificial Sequence
  Synthetic Oligonucleotide
gaatttctactccaccgtagat

SEQ ID NO: 2296 - DNA, 21 bp, Artificial Sequence
  Synthetic Oligonucleotide
caatttctactcattgtagat

SEQ ID NO: 2297 - DNA, 20 bp, Artificial Sequence
  Synthetic Oligonucleotide
caattgatgatcttttattt

SEQ ID NO: 2298 - DNA, 22 bp, Artificial Sequence
  Synthetic Oligonucleotide
caatttctccgtcgccggagat

SEQ ID NO: 2299 - DNA, 21 bp, Artificial Sequence
  Synthetic Oligonucleotide
gaattgtgggtaagtcctatt

SEQ ID NO: 2300 - DNA, 20 bp, Artificial Sequence
  Synthetic Oligonucleotide
caattgtctatctttggact

SEQ ID NO: 2301 - DNA, 21 bp, Artificial Sequence
  Synthetic Oligonucleotide
caatttctccctgtcggagat

SEQ ID NO: 2302 - DNA, 20 bp, Artificial Sequence
  Synthetic Oligonucleotide
gaattcgtcctcttgggcgt

SEQ ID NO: 2303 - DNA, 21 bp, Artificial Sequence
  Synthetic Oligonucleotide
caatttctactaatggtagat

SEQ ID NO: 2304 - DNA, 20 bp, Artificial Sequence
  Synthetic Oligonucleotide
caattggggatcttttcctt

SEQ ID NO: 2305 - DNA, 21 bp, Artificial Sequence
  Synthetic Oligonucleotide
caatttctactgcttgtagat

SEQ ID NO: 2306 - DNA, 20 bp, Artificial Sequence
  Synthetic Oligonucleotide
caatttctacaaaagtagat

SEQ ID NO: 2307 - DNA, 21 bp, Artificial Sequence
  Synthetic Oligonucleotide
gaatttctcctgcacggagat

SEQ ID NO: 2308 - DNA, 22 bp, Artificial Sequence
  Synthetic Oligonucleotide
gaatttctactccatagtagat

SEQ ID NO: 2309 - DNA, 21 bp, Artificial Sequence
  Synthetic Oligonucleotide
caatttctaccactggtagat

SEQ ID NO: 2310 - DNA, 22 bp, Artificial Sequence
  Synthetic Oligonucleotide
caatttctcctcctctggagat

SEQ ID NO: 2311 - DNA, 20 bp, Artificial Sequence
  Synthetic Oligonucleotide
caatttctcctctcggagat

SEQ ID NO: 2312 - DNA, 21 bp, Artificial Sequence
  Synthetic Oligonucleotide
gaatttctcccagcgggagat

SEQ ID NO: 2313 - DNA, 21 bp, Artificial Sequence
  Synthetic Oligonucleotide
gaatttctactaggagtagat

SEQ ID NO: 2314 - DNA, 22 bp, Artificial Sequence
  Synthetic Oligonucleotide
caatttctccctcagcggagat

SEQ ID NO: 2315 - DNA, 22 bp, Artificial Sequence
  Synthetic Oligonucleotide
caatttctcccctaccggagat

SEQ ID NO: 2316 - DNA, 22 bp, Artificial Sequence
  Synthetic Oligonucleotide
gaatttctactcgtaagtagat

SEQ ID NO: 2317 - DNA, 21 bp, Artificial Sequence
  Synthetic Oligonucleotide
caatttatggtaagtctatgt

SEQ ID NO: 2318 - DNA, 20 bp, Artificial Sequence
  Synthetic Oligonucleotide
gaatttcgcgtcttcgtggt

SEQ ID NO: 2319 - DNA, 22 bp, Artificial Sequence
  Synthetic Oligonucleotide
gaatttctactaatgtgtagat

SEQ ID NO: 2320 - DNA, 22 bp, Artificial Sequence
  Synthetic Oligonucleotide
caatttctcccctctcggagat

SEQ ID NO: 2321 - DNA, 21 bp, Artificial Sequence
  Synthetic Oligonucleotide
caatttctccggactggagat

SEQ ID NO: 2322 - DNA, 22 bp, Artificial Sequence
  Synthetic Oligonucleotide
caatttctacctggaagtagat

SEQ ID NO: 2323 - DNA, 22 bp, Artificial Sequence
  Synthetic Oligonucleotide
caatttctccccgttcggagat

SEQ ID NO: 2324 - DNA, 20 bp, Artificial Sequence
  Synthetic Oligonucleotide
caattgttactcttgtggtt

SEQ ID NO: 2325 - DNA, 22 bp, Artificial Sequence
  Synthetic Oligonucleotide
caatttctccccacccggagat

SEQ ID NO: 2326 - DNA, 21 bp, Artificial Sequence
  Synthetic Oligonucleotide
aaattgtgtttaagtgacact

SEQ ID NO: 2327 - DNA, 20 bp, Artificial Sequence
  Synthetic Oligonucleotide
caatttggcttcttggttat

SEQ ID NO: 2328 - DNA, 20 bp, Artificial Sequence
  Synthetic Oligonucleotide
gaattgggcatctttgctct

SEQ ID NO: 2329 - DNA, 21 bp, Artificial Sequence
  Synthetic Oligonucleotide
gaatttctacttcgtgtagat

SEQ ID NO: 2330 - DNA, 21 bp, Artificial Sequence
  Synthetic Oligonucleotide
gaattgtgtttaagtggcact

SEQ ID NO: 2331 - DNA, 22 bp, Artificial Sequence
  Synthetic Oligonucleotide
aaatttctactagagggtagat

SEQ ID NO: 2332 - DNA, 22 bp, Artificial Sequence
  Synthetic Oligonucleotide
gaatttctacttccttgtagat

SEQ ID NO: 2333 - DNA, 21 bp, Artificial Sequence
  Synthetic Oligonucleotide
gaatttctactaagagtagat

SEQ ID NO: 2334 - DNA, 21 bp, Artificial Sequence
  Synthetic Oligonucleotide
gaatttctactatgagtagat

SEQ ID NO: 2335 - DNA, 21 bp, Artificial Sequence
  Synthetic Oligonucleotide
gaatttctactatgtgtagat

SEQ ID NO: 2336 - DNA, 21 bp, Artificial Sequence
  Synthetic Oligonucleotide
aaatttctacttggcgtagat

SEQ ID NO: 2337 - DNA, 21 bp, Artificial Sequence
  Synthetic Oligonucleotide
aaatttctactaagtgtagat

SEQ ID NO: 2338 - DNA, 22 bp, Artificial Sequence
  Synthetic Oligonucleotide
gaatttctactacggggtagat

SEQ ID NO: 2339 - DNA, 20 bp, Artificial Sequence
  Synthetic Oligonucleotide
aaatttctactatggtagat

SEQ ID NO: 2340 - DNA, 21 bp, Artificial Sequence
  Synthetic Oligonucleotide
caatttctactaagcgtagat

SEQ ID NO: 2341 - DNA, 22 bp, Artificial Sequence
  Synthetic Oligonucleotide
gaatttctactaacgagtagat

SEQ ID NO: 2342 - DNA, 22 bp, Artificial Sequence
  Synthetic Oligonucleotide
caatttctactattatgtagat

SEQ ID NO: 2343 - DNA, 22 bp, Artificial Sequence
  Synthetic Oligonucleotide
aaatttctactaaagtgtagat

SEQ ID NO: 2344 - DNA, 21 bp, Artificial Sequence
  Synthetic Oligonucleotide
aaatttctactagtagtagat

SEQ ID NO: 2345 - DNA, 21 bp, Artificial Sequence
  Synthetic Oligonucleotide
gaatttctactcttcgtagat

SEQ ID NO: 2346 - DNA, 21 bp, Artificial Sequence
  Synthetic Oligonucleotide
aaatttctcctacggggagat

SEQ ID NO: 2347 - DNA, 21 bp, Artificial Sequence
  Synthetic Oligonucleotide
aaatttctactttgtgtagat

SEQ ID NO: 2348 - DNA, 22 bp, Artificial Sequence
  Synthetic Oligonucleotide
aaatttctacttctgcgtagat

SEQ ID NO: 2349 - DNA, 21 bp, Artificial Sequence
  Synthetic Oligonucleotide
gaatttctactcagggtagat

SEQ ID NO: 2350 - DNA, 21 bp, Artificial Sequence
  Synthetic Oligonucleotide
aaatttctactatgtgtagat

SEQ ID NO: 2351 - DNA, 22 bp, Artificial Sequence
  Synthetic Oligonucleotide
caatttctactgacgggtagat

SEQ ID NO: 2352 - DNA, 22 bp, Artificial Sequence
  Synthetic Oligonucleotide
aaatttctactaaggcgtagat

SEQ ID NO: 2353 - DNA, 22 bp, Artificial Sequence
  Synthetic Oligonucleotide
gaatttctactcgtccgtagat

SEQ ID NO: 2354 - DNA, 22 bp, Artificial Sequence
  Synthetic Oligonucleotide
aaatttctactaacgtgtagat

SEQ ID NO: 2355 - DNA, 21 bp, Artificial Sequence
  Synthetic Oligonucleotide
aaatttctacttatcgtagat

SEQ ID NO: 2356 - DNA, 22 bp, Artificial Sequence
  Synthetic Oligonucleotide
gaatttctactcccgggtagat

SEQ ID NO: 2357 - DNA, 21 bp, Artificial Sequence
  Synthetic Oligonucleotide
aaatttctactaggtgtagat

SEQ ID NO: 2358 - DNA, 22 bp, Artificial Sequence
  Synthetic Oligonucleotide
gaatttctacttagccgtagat

SEQ ID NO: 2359 - DNA, 22 bp, Artificial Sequence
  Synthetic Oligonucleotide
caatttctactagagagtagat

SEQ ID NO: 2360 - DNA, 22 bp, Artificial Sequence
  Synthetic Oligonucleotide
gaatttctactacttcgtagat

SEQ ID NO: 2361 - DNA, 21 bp, Artificial Sequence
  Synthetic Oligonucleotide
aaatttctcctgggtggagat

SEQ ID NO: 2362 - DNA, 22 bp, Artificial Sequence
  Synthetic Oligonucleotide
aaatttctacttccaggtagat

SEQ ID NO: 2363 - DNA, 22 bp, Artificial Sequence
  Synthetic Oligonucleotide
aaatttctacttcggtgtagat

SEQ ID NO: 2364 - DNA, 21 bp, Artificial Sequence
  Synthetic Oligonucleotide
aaatttctactgaccgtagat

SEQ ID NO: 2365 - DNA, 22 bp, Artificial Sequence
  Synthetic Oligonucleotide
gaatttctactaagcagtagat

SEQ ID NO: 2366 - DNA, 21 bp, Artificial Sequence
  Synthetic Oligonucleotide
gaatttctcctaaggggagat

SEQ ID NO: 2367 - DNA, 21 bp, Artificial Sequence
  Synthetic Oligonucleotide
caattttagttaagtattaat

SEQ ID NO: 2368 - DNA, 22 bp, Artificial Sequence
  Synthetic Oligonucleotide
gaatttctactatttcgtagat

SEQ ID NO: 2369 - DNA, 22 bp, Artificial Sequence
  Synthetic Oligonucleotide
gaatttctactaaattgtagat

SEQ ID NO: 2370 - DNA, 22 bp, Artificial Sequence
  Synthetic Oligonucleotide
gaatttctactcattagtagat

SEQ ID NO: 2371 - DNA, 22 bp, Artificial Sequence
  Synthetic Oligonucleotide
gaatttctactgaagtgtagat

SEQ ID NO: 2372 - DNA, 22 bp, Artificial Sequence
  Synthetic Oligonucleotide
gaatttctactcaagtgtagat

SEQ ID NO: 2373 - DNA, 22 bp, Artificial Sequence
  Synthetic Oligonucleotide
aaatttctactaaagggtagat

SEQ ID NO: 2374 - DNA, 21 bp, Artificial Sequence
  Synthetic Oligonucleotide
aaatttctactattagtagat

SEQ ID NO: 2375 - DNA, 21 bp, Artificial Sequence
  Synthetic Oligonucleotide
gaatttctactcggggtagat

SEQ ID NO: 2376 - DNA, 21 bp, Artificial Sequence
  Synthetic Oligonucleotide
aaatttctacttgccgtagat

SEQ ID NO: 2377 - DNA, 21 bp, Artificial Sequence
  Synthetic Oligonucleotide
aaattctcgttaagtgtgggt

SEQ ID NO: 2378 - DNA, 21 bp, Artificial Sequence
  Synthetic Oligonucleotide
gaatttctactctacgtagat

SEQ ID NO: 2379 - DNA, 22 bp, Artificial Sequence
  Synthetic Oligonucleotide
aaatttctcctatagcggagat

SEQ ID NO: 2380 - DNA, 20 bp, Artificial Sequence
  Synthetic Oligonucleotide
aaattcgtggtcttccacgt

SEQ ID NO: 2381 - DNA, 21 bp, Artificial Sequence
  Synthetic Oligonucleotide
aaatttctacttcaagtagat

SEQ ID NO: 2382 - DNA, 21 bp, Artificial Sequence
  Synthetic Oligonucleotide
caatttctacttagtgtagat

SEQ ID NO: 2383 - DNA, 22 bp, Artificial Sequence
  Synthetic Oligonucleotide
gaatttctactccttagtagat

SEQ ID NO: 2384 - DNA, 22 bp, Artificial Sequence
  Synthetic Oligonucleotide
aaatttctactgaagtgtagat

SEQ ID NO: 2385 - DNA, 22 bp, Artificial Sequence
  Synthetic Oligonucleotide
caatttctacttgggagtagat

SEQ ID NO: 2386 - DNA, 22 bp, Artificial Sequence
  Synthetic Oligonucleotide
caatttctactcatatgtagat

SEQ ID NO: 2387 - DNA, 22 bp, Artificial Sequence
  Synthetic Oligonucleotide
aaatttctactgtgtcgtagat

SEQ ID NO: 2388 - DNA, 22 bp, Artificial Sequence
  Synthetic Oligonucleotide
caatttctacacgaatgtagat

SEQ ID NO: 2389 - DNA, 22 bp, Artificial Sequence
  Synthetic Oligonucleotide
caatttctcctactgtggagat

SEQ ID NO: 2390 - DNA, 22 bp, Artificial Sequence
  Synthetic Oligonucleotide
caatttctactagtgagtagat

SEQ ID NO: 2391 - DNA, 22 bp, Artificial Sequence
  Synthetic Oligonucleotide
aaatttctacttacgcgtagat

SEQ ID NO: 2392 - DNA, 21 bp, Artificial Sequence
  Synthetic Oligonucleotide
gaatttctaccatctgtagat

SEQ ID NO: 2393 - DNA, 20 bp, Artificial Sequence
  Synthetic Oligonucleotide
gaatttctacttttgtagat

SEQ ID NO: 2394 - DNA, 21 bp, Artificial Sequence
  Synthetic Oligonucleotide
gaatttctcctatttggagat

SEQ ID NO: 2395 - DNA, 21 bp, Artificial Sequence
  Synthetic Oligonucleotide
caatttttactaagtgtaggt

SEQ ID NO: 2396 - DNA, 22 bp, Artificial Sequence
  Synthetic Oligonucleotide
gaatttctactaaacagtagat

SEQ ID NO: 2397 - DNA, 22 bp, Artificial Sequence
  Synthetic Oligonucleotide
gaatttctactcttctgtagat

SEQ ID NO: 2398 - DNA, 21 bp, Artificial Sequence
  Synthetic Oligonucleotide
aaatttctactagtcgtagat

SEQ ID NO: 2399 - DNA, 22 bp, Artificial Sequence
  Synthetic Oligonucleotide
gaatttctacttacctgtagat

SEQ ID NO: 2400 - DNA, 20 bp, Artificial Sequence
  Synthetic Oligonucleotide
caattgggtttcttgaccct

SEQ ID NO: 2401 - DNA, 21 bp, Artificial Sequence
  Synthetic Oligonucleotide
aaatttctcctaagtggagat

SEQ ID NO: 2402 - DNA, 21 bp, Artificial Sequence
  Synthetic Oligonucleotide
gaatttctcctacgtggagat

SEQ ID NO: 2403 - DNA, 21 bp, Artificial Sequence
  Synthetic Oligonucleotide
gaatttctactacgggtagat

SEQ ID NO: 2404 - DNA, 22 bp, Artificial Sequence
  Synthetic Oligonucleotide
gaatttctactaggatgtagat

SEQ ID NO: 2405 - DNA, 20 bp, Artificial Sequence
  Synthetic Oligonucleotide
aaattggtgttcttgtgctt

SEQ ID NO: 2406 - DNA, 22 bp, Artificial Sequence
  Synthetic Oligonucleotide
gaatttctactatatcgtagat

SEQ ID NO: 2407 - DNA, 22 bp, Artificial Sequence
  Synthetic Oligonucleotide
caatttctacttccaagtagat

SEQ ID NO: 2408 - DNA, 22 bp, Artificial Sequence
  Synthetic Oligonucleotide
aaatttctactgggccgtagat

SEQ ID NO: 2409 - DNA, 21 bp, Artificial Sequence
  Synthetic Oligonucleotide
caatttctcctagctggagat

SEQ ID NO: 2410 - DNA, 21 bp, Artificial Sequence
  Synthetic Oligonucleotide
gaatttctactgcgagtagat

SEQ ID NO: 2411 - DNA, 21 bp, Artificial Sequence
  Synthetic Oligonucleotide
caatttctcgtaagtcgagat

SEQ ID NO: 2412 - DNA, 22 bp, Artificial Sequence
  Synthetic Oligonucleotide
gaatttctactcgcgtgtagat

SEQ ID NO: 2413 - DNA, 22 bp, Artificial Sequence
  Synthetic Oligonucleotide
caatttctactcaaacgtagat

SEQ ID NO: 2414 - DNA, 21 bp, Artificial Sequence
  Synthetic Oligonucleotide
aaatttctactatttgtagat

SEQ ID NO: 2415 - DNA, 22 bp, Artificial Sequence
  Synthetic Oligonucleotide
gaatttctactgcttagtagat

SEQ ID NO: 2416 - DNA, 22 bp, Artificial Sequence
  Synthetic Oligonucleotide
caatttctactagagtgtagat

SEQ ID NO: 2417 - DNA, 22 bp, Artificial Sequence
  Synthetic Oligonucleotide
aaatttctacttacgagtagat

SEQ ID NO: 2418 - DNA, 22 bp, Artificial Sequence
  Synthetic Oligonucleotide
gaatttctactacagcgtagat

SEQ ID NO: 2419 - DNA, 21 bp, Artificial Sequence
  Synthetic Oligonucleotide
gaatttctacttcgagtagat

SEQ ID NO: 2420 - DNA, 21 bp, Artificial Sequence
  Synthetic Oligonucleotide
aaatttctactcggtgtagat

SEQ ID NO: 2421 - DNA, 21 bp, Artificial Sequence
  Synthetic Oligonucleotide
aaatttctactctaagtagat

SEQ ID NO: 2422 - DNA, 22 bp, Artificial Sequence
  Synthetic Oligonucleotide
caatttctactcggttgtagat

SEQ ID NO: 2423 - DNA, 21 bp, Artificial Sequence
  Synthetic Oligonucleotide
gaatttctactcatggtagat

SEQ ID NO: 2424 - DNA, 22 bp, Artificial Sequence
  Synthetic Oligonucleotide
aaatttctactaacgcgtagat

SEQ ID NO: 2425 - DNA, 22 bp, Artificial Sequence
  Synthetic Oligonucleotide
gaatttctactccagagtagat

SEQ ID NO: 2426 - DNA, 22 bp, Artificial Sequence
  Synthetic Oligonucleotide
gaatttctactagcttgtagat

SEQ ID NO: 2427 - DNA, 21 bp, Artificial Sequence
  Synthetic Oligonucleotide
caatttctacttcaagtagat

SEQ ID NO: 2428 - DNA, 22 bp, Artificial Sequence
  Synthetic Oligonucleotide
aaatttctactccatcgtagat

SEQ ID NO: 2429 - DNA, 21 bp, Artificial Sequence
  Synthetic Oligonucleotide
gaatttctgctaagtgcagat

SEQ ID NO: 2430 - DNA, 22 bp, Artificial Sequence
  Synthetic Oligonucleotide
gaatttctactagcgtgtagat

SEQ ID NO: 2431 - DNA, 22 bp, Artificial Sequence
  Synthetic Oligonucleotide
aaatttctactccggcgtagat

SEQ ID NO: 2432 - DNA, 22 bp, Artificial Sequence
  Synthetic Oligonucleotide
caatttctactagcgagtagat

SEQ ID NO: 2433 - DNA, 22 bp, Artificial Sequence
  Synthetic Oligonucleotide
gaatttctactgatgggtagat

SEQ ID NO: 2434 - DNA, 22 bp, Artificial Sequence
  Synthetic Oligonucleotide
gaatttctactttgttgtagat

SEQ ID NO: 2435 - DNA, 22 bp, Artificial Sequence
  Synthetic Oligonucleotide
caatttctactatcgggtagat

SEQ ID NO: 2436 - DNA, 21 bp, Artificial Sequence
  Synthetic Oligonucleotide
aaatttctactactcgtagat

SEQ ID NO: 2437 - DNA, 22 bp, Artificial Sequence
  Synthetic Oligonucleotide
gaatttctactagaacgtagat

SEQ ID NO: 2438 - DNA, 20 bp, Artificial Sequence
  Synthetic Oligonucleotide
gaatttctactaccgtagat

SEQ ID NO: 2439 - DNA, 21 bp, Artificial Sequence
  Synthetic Oligonucleotide
caatttctactagcagtagat

SEQ ID NO: 2440 - DNA, 21 bp, Artificial Sequence
  Synthetic Oligonucleotide
gaatttctactgtccgtagat

SEQ ID NO: 2441 - DNA, 21 bp, Artificial Sequence
  Synthetic Oligonucleotide
caatttttactaagtgtaaat

SEQ ID NO: 2442 - DNA, 21 bp, Artificial Sequence
  Synthetic Oligonucleotide
gaatttctactgtaagtagat

SEQ ID NO: 2443 - DNA, 22 bp, Artificial Sequence
  Synthetic Oligonucleotide
gaatttctactcacgagtagat

SEQ ID NO: 2444 - DNA, 22 bp, Artificial Sequence
  Synthetic Oligonucleotide
gaatttctactcaagcgtagat

SEQ ID NO: 2445 - DNA, 22 bp, Artificial Sequence
  Synthetic Oligonucleotide
gaatttctacaggttggtagat

SEQ ID NO: 2446 - DNA, 22 bp, Artificial Sequence
  Synthetic Oligonucleotide
gaatttctactgaccagtagat

SEQ ID NO: 2447 - DNA, 22 bp, Artificial Sequence
  Synthetic Oligonucleotide
gaatttctacttccgggtagat

SEQ ID NO: 2448 - DNA, 21 bp, Artificial Sequence
  Synthetic Oligonucleotide
caatttctactactcgtagat

SEQ ID NO: 2449 - DNA, 20 bp, Artificial Sequence
  Synthetic Oligonucleotide
gaattggttatctttgatct

SEQ ID NO: 2450 - DNA, 22 bp, Artificial Sequence
  Synthetic Oligonucleotide
gaatttctacttcggcgtagat

SEQ ID NO: 2451 - DNA, 21 bp, Artificial Sequence
  Synthetic Oligonucleotide
gaatttaggttaagtgtttat

SEQ ID NO: 2452 - DNA, 21 bp, Artificial Sequence
  Synthetic Oligonucleotide
caatttctacttaatgtagat

SEQ ID NO: 2453 - DNA, 22 bp, Artificial Sequence
  Synthetic Oligonucleotide
aaatttctactcgtgcgtagat

SEQ ID NO: 2454 - DNA, 20 bp, Artificial Sequence
  Synthetic Oligonucleotide
caatttctcctatgggagat

SEQ ID NO: 2455 - DNA, 21 bp, Artificial Sequence
  Synthetic Oligonucleotide
caatttctactttgtgtagat

SEQ ID NO: 2456 - DNA, 22 bp, Artificial Sequence
  Synthetic Oligonucleotide
caatttctactaaatagtagat

SEQ ID NO: 2457 - DNA, 20 bp, Artificial Sequence
  Synthetic Oligonucleotide
aaatttctactcccgtagat

SEQ ID NO: 2458 - DNA, 22 bp, Artificial Sequence
  Synthetic Oligonucleotide
caatttctactaacaagtagat

SEQ ID NO: 2459 - DNA, 22 bp, Artificial Sequence
  Synthetic Oligonucleotide
gaatttctactaccaagtagat

SEQ ID NO: 2460 - DNA, 21 bp, Artificial Sequence
  Synthetic Oligonucleotide
aaatttctactccacgtagat

SEQ ID NO: 2461 - DNA, 22 bp, Artificial Sequence
  Synthetic Oligonucleotide
gaatttctactgttcagtagat

SEQ ID NO: 2462 - DNA, 22 bp, Artificial Sequence
  Synthetic Oligonucleotide
caatttctactttggagtagat

SEQ ID NO: 2463 - DNA, 21 bp, Artificial Sequence
  Synthetic Oligonucleotide
gaatttctactgattgtagat

SEQ ID NO: 2464 - DNA, 22 bp, Artificial Sequence
  Synthetic Oligonucleotide
aaatttctactacacagtagat

SEQ ID NO: 2465 - DNA, 21 bp, Artificial Sequence
  Synthetic Oligonucleotide
aaatttctacttgcggtagat

SEQ ID NO: 2466 - DNA, 22 bp, Artificial Sequence
  Synthetic Oligonucleotide
gaatttctactgtcgagtagat

SEQ ID NO: 2467 - DNA, 21 bp, Artificial Sequence
  Synthetic Oligonucleotide
aaatttctacttgatgtagat

SEQ ID NO: 2468 - DNA, 22 bp, Artificial Sequence
  Synthetic Oligonucleotide
gaatttctactaacaggtagat

SEQ ID NO: 2469 - DNA, 22 bp, Artificial Sequence
  Synthetic Oligonucleotide
caatttctacttaaatgtagat

SEQ ID NO: 2470 - DNA, 21 bp, Artificial Sequence
  Synthetic Oligonucleotide
caatttttgctaagtgcaggt

SEQ ID NO: 2471 - DNA, 21 bp, Artificial Sequence
  Synthetic Oligonucleotide
caatttcttctaagtgaaggt

SEQ ID NO: 2472 - DNA, 22 bp, Artificial Sequence
  Synthetic Oligonucleotide
caatttctacttgtttgtagat

SEQ ID NO: 2473 - DNA, 22 bp, Artificial Sequence
  Synthetic Oligonucleotide
aaatttctacttaattgtagat

SEQ ID NO: 2474 - DNA, 21 bp, Artificial Sequence
  Synthetic Oligonucleotide
gaattcctcgtaagtcgaggt

SEQ ID NO: 2475 - DNA, 22 bp, Artificial Sequence
  Synthetic Oligonucleotide
gaatttctactggtgggtagat

SEQ ID NO: 2476 - DNA, 21 bp, Artificial Sequence
  Synthetic Oligonucleotide
aaatttctactaaccgtagat

SEQ ID NO: 2477 - DNA, 21 bp, Artificial Sequence
  Synthetic Oligonucleotide
aaattggcactaagtgtgttt

SEQ ID NO: 2478 - DNA, 22 bp, Artificial Sequence
  Synthetic Oligonucleotide
gaatttctactttagtgtagat

SEQ ID NO: 2479 - DNA, 20 bp, Artificial Sequence
  Synthetic Oligonucleotide
gaatttctactaatgtagat

SEQ ID NO: 2480 - DNA, 22 bp, Artificial Sequence
  Synthetic Oligonucleotide
gaatttctactccattgtagat

SEQ ID NO: 2481 - DNA, 22 bp, Artificial Sequence
  Synthetic Oligonucleotide
caatttctactactctgtagat

SEQ ID NO: 2482 - DNA, 21 bp, Artificial Sequence
  Synthetic Oligonucleotide
gaatttctactcactgtagat

SEQ ID NO: 2483 - DNA, 22 bp, Artificial Sequence
  Synthetic Oligonucleotide
aaatttctactcgtgagtagat

SEQ ID NO: 2484 - DNA, 22 bp, Artificial Sequence
  Synthetic Oligonucleotide
caatttctactatggagtagat

SEQ ID NO: 2485 - DNA, 21 bp, Artificial Sequence
  Synthetic Oligonucleotide
aaatttctactgggagtagat

SEQ ID NO: 2486 - DNA, 22 bp, Artificial Sequence
  Synthetic Oligonucleotide
caatttctactttttcgtagat

SEQ ID NO: 2487 - DNA, 21 bp, Artificial Sequence
  Synthetic Oligonucleotide
gaatttctactgatcgtagat

SEQ ID NO: 2488 - DNA, 22 bp, Artificial Sequence
  Synthetic Oligonucleotide
caatttctactgatttgtagat

SEQ ID NO: 2489 - DNA, 22 bp, Artificial Sequence
  Synthetic Oligonucleotide
caatttctactagaatgtagat

SEQ ID NO: 2490 - DNA, 22 bp, Artificial Sequence
  Synthetic Oligonucleotide
caatttctactacagcgtagat

SEQ ID NO: 2491 - DNA, 21 bp, Artificial Sequence
  Synthetic Oligonucleotide
caatttctactacaagtagat

SEQ ID NO: 2492 - DNA, 21 bp, Artificial Sequence
  Synthetic Oligonucleotide
gaatttctcctaagtggagat

SEQ ID NO: 2493 - DNA, 22 bp, Artificial Sequence
  Synthetic Oligonucleotide
gaatttctactactgcgtagat

SEQ ID NO: 2494 - DNA, 22 bp, Artificial Sequence
  Synthetic Oligonucleotide
caatttctactatctagtagat

SEQ ID NO: 2495 - DNA, 22 bp, Artificial Sequence
  Synthetic Oligonucleotide
gaatttctacttcgaggtagat

SEQ ID NO: 2496 - DNA, 21 bp, Artificial Sequence
  Synthetic Oligonucleotide
caatttctacttcttgtagat

SEQ ID NO: 2497 - DNA, 22 bp, Artificial Sequence
  Synthetic Oligonucleotide
caatttctactgtgatgtagat

SEQ ID NO: 2498 - DNA, 22 bp, Artificial Sequence
  Synthetic Oligonucleotide
caatttctactagcgtgtagat

SEQ ID NO: 2499 - DNA, 21 bp, Artificial Sequence
  Synthetic Oligonucleotide
aaatttctactacatgtagat

SEQ ID NO: 2500 - DNA, 22 bp, Artificial Sequence
  Synthetic Oligonucleotide
gaatttctactggtgagtagat

SEQ ID NO: 2501 - DNA, 22 bp, Artificial Sequence
  Synthetic Oligonucleotide
gaatttctactaccctgtagat

SEQ ID NO: 2502 - DNA, 21 bp, Artificial Sequence
  Synthetic Oligonucleotide
caatttctactcaatgtagat

SEQ ID NO: 2503 - DNA, 21 bp, Artificial Sequence
  Synthetic Oligonucleotide
gaatttctcctattaggagat

SEQ ID NO: 2504 - DNA, 21 bp, Artificial Sequence
  Synthetic Oligonucleotide
aaatttctactttcggtagat

SEQ ID NO: 2505 - DNA, 21 bp, Artificial Sequence
  Synthetic Oligonucleotide
caatttcgactaagtgtcgat

SEQ ID NO: 2506 - DNA, 22 bp, Artificial Sequence
  Synthetic Oligonucleotide
caatttctcctactgcggagat

SEQ ID NO: 2507 - DNA, 22 bp, Artificial Sequence
  Synthetic Oligonucleotide
aaatttctcctggatgggagat

SEQ ID NO: 2508 - DNA, 22 bp, Artificial Sequence
  Synthetic Oligonucleotide
caatttctactatcgagtagat

SEQ ID NO: 2509 - DNA, 22 bp, Artificial Sequence
  Synthetic Oligonucleotide
caatttctactctggtgtagat

SEQ ID NO: 2510 - DNA, 20 bp, Artificial Sequence
  Synthetic Oligonucleotide
gaatttctactcctgtagat

SEQ ID NO: 2511 - DNA, 22 bp, Artificial Sequence
  Synthetic Oligonucleotide
caatttctcctagtgaggagat

SEQ ID NO: 2512 - DNA, 22 bp, Artificial Sequence
  Synthetic Oligonucleotide
caatttctacttcaaagtagat

SEQ ID NO: 2513 - DNA, 22 bp, Artificial Sequence
  Synthetic Oligonucleotide
caatttctactagagcgtagat

SEQ ID NO: 2514 - DNA, 21 bp, Artificial Sequence
  Synthetic Oligonucleotide
gaatttctactgtgtgtagat

SEQ ID NO: 2515 - DNA, 22 bp, Artificial Sequence
  Synthetic Oligonucleotide
caatttctactttgtagtagat

SEQ ID NO: 2516 - DNA, 22 bp, Artificial Sequence
  Synthetic Oligonucleotide
caatttctacttcagagtagat

SEQ ID NO: 2517 - DNA, 22 bp, Artificial Sequence
  Synthetic Oligonucleotide
gaatttctactagcatgtagat

SEQ ID NO: 2518 - DNA, 22 bp, Artificial Sequence
  Synthetic Oligonucleotide
caatttctcctattgcggagat

SEQ ID NO: 2519 - DNA, 21 bp, Artificial Sequence
  Synthetic Oligonucleotide
aaatttctactgtacgtagat

SEQ ID NO: 2520 - DNA, 22 bp, Artificial Sequence
  Synthetic Oligonucleotide
aaatttctactcgcatgtagat

SEQ ID NO: 2521 - DNA, 21 bp, Artificial Sequence
  Synthetic Oligonucleotide
caatttctactaagggtagat

SEQ ID NO: 2522 - DNA, 21 bp, Artificial Sequence
  Synthetic Oligonucleotide
caatttctaccggacgtagat

SEQ ID NO: 2523 - DNA, 22 bp, Artificial Sequence
  Synthetic Oligonucleotide
gaatttctacttcttcgtagat

SEQ ID NO: 2524 - DNA, 21 bp, Artificial Sequence
  Synthetic Oligonucleotide
gaatttctactccgtgtagat

SEQ ID NO: 2525 - DNA, 21 bp, Artificial Sequence
  Synthetic Oligonucleotide
caatttctactagttgtagat

SEQ ID NO: 2526 - DNA, 22 bp, Artificial Sequence
  Synthetic Oligonucleotide
gaatttctactaacttgtagat

SEQ ID NO: 2527 - DNA, 22 bp, Artificial Sequence
  Synthetic Oligonucleotide
gaatttctactactgtgtagat

SEQ ID NO: 2528 - DNA, 21 bp, Artificial Sequence
  Synthetic Oligonucleotide
aaatttctactgaacgtagat

SEQ ID NO: 2529 - DNA, 21 bp, Artificial Sequence
  Synthetic Oligonucleotide
caatttctcctgggtggagat

SEQ ID NO: 2530 - DNA, 21 bp, Artificial Sequence
  Synthetic Oligonucleotide
gaatttctactcgacgtagat

SEQ ID NO: 2531 - DNA, 22 bp, Artificial Sequence
  Synthetic Oligonucleotide
gaatttctactcgcatgtagat

SEQ ID NO: 2532 - DNA, 21 bp, Artificial Sequence
  Synthetic Oligonucleotide
caatttctactcgtagtagat

SEQ ID NO: 2533 - DNA, 21 bp, Artificial Sequence
  Synthetic Oligonucleotide
gaatttctcctacgcggagat

SEQ ID NO: 2534 - DNA, 21 bp, Artificial Sequence
  Synthetic Oligonucleotide
caatttctacaatcggtagat

SEQ ID NO: 2535 - DNA, 21 bp, Artificial Sequence
  Synthetic Oligonucleotide
caatttctactaagtgtggat

SEQ ID NO: 2536 - DNA, 22 bp, Artificial Sequence
  Synthetic Oligonucleotide
gaatttctactttctagtagat

SEQ ID NO: 2537 - DNA, 21 bp, Artificial Sequence
  Synthetic Oligonucleotide
aaatttctacttgtggtagat

SEQ ID NO: 2538 - DNA, 22 bp, Artificial Sequence
  Synthetic Oligonucleotide
caatttctactactgagtagat

SEQ ID NO: 2539 - DNA, 21 bp, Artificial Sequence
  Synthetic Oligonucleotide
caatttctacttaaggtagat

SEQ ID NO: 2540 - DNA, 21 bp, Artificial Sequence
  Synthetic Oligonucleotide
gaatttctcctaggcggagat

SEQ ID NO: 2541 - DNA, 22 bp, Artificial Sequence
  Synthetic Oligonucleotide
caatttctactacgaggtagat

SEQ ID NO: 2542 - DNA, 21 bp, Artificial Sequence
  Synthetic Oligonucleotide
caattctgggtaagtcttggt

SEQ ID NO: 2543 - DNA, 22 bp, Artificial Sequence
  Synthetic Oligonucleotide
gaatttctactttaaggtagat

SEQ ID NO: 2544 - DNA, 20 bp, Artificial Sequence
  Synthetic Oligonucleotide
gaattgacagtcttctgtct

SEQ ID NO: 2545 - DNA, 22 bp, Artificial Sequence
  Synthetic Oligonucleotide
gaatttctactggtccgtagat

SEQ ID NO: 2546 - DNA, 22 bp, Artificial Sequence
  Synthetic Oligonucleotide
caatttctactgttaagtagat

SEQ ID NO: 2547 - DNA, 22 bp, Artificial Sequence
  Synthetic Oligonucleotide
caatttctactacgctgtagat

SEQ ID NO: 2548 - DNA, 21 bp, Artificial Sequence
  Synthetic Oligonucleotide
caatttctacttcgtgtagat

SEQ ID NO: 2549 - DNA, 22 bp, Artificial Sequence
  Synthetic Oligonucleotide
aaatttctactcgattgtagat

SEQ ID NO: 2550 - DNA, 22 bp, Artificial Sequence
  Synthetic Oligonucleotide
caatttctacttcttagtagat

SEQ ID NO: 2551 - DNA, 21 bp, Artificial Sequence
  Synthetic Oligonucleotide
aaatttctacttcgtgtagat

SEQ ID NO: 2552 - DNA, 20 bp, Artificial Sequence
  Synthetic Oligonucleotide
caattatggctcttgtcgtt

SEQ ID NO: 2553 - DNA, 22 bp, Artificial Sequence
  Synthetic Oligonucleotide
aaatttctacttgttagtagat

SEQ ID NO: 2554 - DNA, 21 bp, Artificial Sequence
  Synthetic Oligonucleotide
aaatttctactgtccgtagat

SEQ ID NO: 2555 - DNA, 22 bp, Artificial Sequence
  Synthetic Oligonucleotide
caatttctactaatctgtagat

SEQ ID NO: 2556 - DNA, 22 bp, Artificial Sequence
  Synthetic Oligonucleotide
aaatttctactacaaggtagat

SEQ ID NO: 2557 - DNA, 21 bp, Artificial Sequence
  Synthetic Oligonucleotide
aaatttctcctaggaggagat

SEQ ID NO: 2558 - DNA, 20 bp, Artificial Sequence
  Synthetic Oligonucleotide
gaatttctactcaggtagat

SEQ ID NO: 2559 - DNA, 22 bp, Artificial Sequence
  Synthetic Oligonucleotide
caatttctactcggccgtagat

SEQ ID NO: 2560 - DNA, 22 bp, Artificial Sequence
  Synthetic Oligonucleotide
caatttctacttatccgtagat

SEQ ID NO: 2561 - DNA, 21 bp, Artificial Sequence
  Synthetic Oligonucleotide
aaatttcgcctaagtggcgat

SEQ ID NO: 2562 - DNA, 21 bp, Artificial Sequence
  Synthetic Oligonucleotide
aaatttctactcgtggtagat

SEQ ID NO: 2563 - DNA, 21 bp, Artificial Sequence
  Synthetic Oligonucleotide
caatttctcctttgtggagat

SEQ ID NO: 2564 - DNA, 21 bp, Artificial Sequence
  Synthetic Oligonucleotide
caatttctacaaactgtagat

SEQ ID NO: 2565 - DNA, 21 bp, Artificial Sequence
  Synthetic Oligonucleotide
gaatttctcctagatggagat

SEQ ID NO: 2566 - DNA, 22 bp, Artificial Sequence
  Synthetic Oligonucleotide
caatttctcctaaggtggagat

SEQ ID NO: 2567 - DNA, 22 bp, Artificial Sequence
  Synthetic Oligonucleotide
caatttctacttttcagtagat

SEQ ID NO: 2568 - DNA, 20 bp, Artificial Sequence
  Synthetic Oligonucleotide
gaatttctacatctgtagat

SEQ ID NO: 2569 - DNA, 21 bp, Artificial Sequence
  Synthetic Oligonucleotide
aaatttctactgtctgtagat

SEQ ID NO: 2570 - DNA, 21 bp, Artificial Sequence
  Synthetic Oligonucleotide
gaatttctactttccgtagat

SEQ ID NO: 2571 - DNA, 21 bp, Artificial Sequence
  Synthetic Oligonucleotide
aaatttctactgtaagtagat

SEQ ID NO: 2572 - DNA, 22 bp, Artificial Sequence
  Synthetic Oligonucleotide
gaatttctactggtaagtagat

SEQ ID NO: 2573 - DNA, 20 bp, Artificial Sequence
  Synthetic Oligonucleotide
caattgggtctcttggcctt

SEQ ID NO: 2574 - DNA, 21 bp, Artificial Sequence
  Synthetic Oligonucleotide
aaattcgacttaagtggtcgt

SEQ ID NO: 2575 - DNA, 21 bp, Artificial Sequence
  Synthetic Oligonucleotide
gaatttctcctgcgtggagat

SEQ ID NO: 2576 - DNA, 20 bp, Artificial Sequence
  Synthetic Oligonucleotide
caattagcgctcttgtgttt

SEQ ID NO: 2577 - DNA, 22 bp, Artificial Sequence
  Synthetic Oligonucleotide
gaatttctactaaggagtagat

SEQ ID NO: 2578 - DNA, 22 bp, Artificial Sequence
  Synthetic Oligonucleotide
caatttctactgtgtcgtagat

SEQ ID NO: 2579 - DNA, 20 bp, Artificial Sequence
  Synthetic Oligonucleotide
caatttctactacagtagat

SEQ ID NO: 2580 - DNA, 21 bp, Artificial Sequence
  Synthetic Oligonucleotide
gaatttctcctatgcggagat

SEQ ID NO: 2581 - DNA, 22 bp, Artificial Sequence
  Synthetic Oligonucleotide
aaatttctactcccctgtagat

SEQ ID NO: 2582 - DNA, 22 bp, Artificial Sequence
  Synthetic Oligonucleotide
caatttctacttttttgtagat

SEQ ID NO: 2583 - DNA, 22 bp, Artificial Sequence
  Synthetic Oligonucleotide
gaatttctacttcttagtagat

SEQ ID NO: 2584 - DNA, 22 bp, Artificial Sequence
  Synthetic Oligonucleotide
gaatttctactcgtgcgtagat

SEQ ID NO: 2585 - DNA, 21 bp, Artificial Sequence
  Synthetic Oligonucleotide
aaatttctcctaggtggagat

SEQ ID NO: 2586 - DNA, 21 bp, Artificial Sequence
  Synthetic Oligonucleotide
gaatttctactgtacgtagat

SEQ ID NO: 2587 - DNA, 21 bp, Artificial Sequence
  Synthetic Oligonucleotide
caattgtgtgtaagttacgct

SEQ ID NO: 2588 - DNA, 22 bp, Artificial Sequence
  Synthetic Oligonucleotide
gaatttctcctagtgcggagat

SEQ ID NO: 2589 - DNA, 20 bp, Artificial Sequence
  Synthetic Oligonucleotide
caatttctacttgtgtagat

SEQ ID NO: 2590 - DNA, 21 bp, Artificial Sequence
  Synthetic Oligonucleotide
caatttctactttctgtagat

SEQ ID NO: 2591 - DNA, 20 bp, Artificial Sequence
  Synthetic Oligonucleotide
caattcgaattcttattcgt

SEQ ID NO: 2592 - DNA, 22 bp, Artificial Sequence
  Synthetic Oligonucleotide
caatttctactattaagtagat

SEQ ID NO: 2593 - DNA, 22 bp, Artificial Sequence
  Synthetic Oligonucleotide
gaatttctactgattagtagat

SEQ ID NO: 2594 - DNA, 22 bp, Artificial Sequence
  Synthetic Oligonucleotide
gaatttctactagggcgtagat

SEQ ID NO: 2595 - DNA, 21 bp, Artificial Sequence
  Synthetic Oligonucleotide
gaattcggggtaagtctctgt

SEQ ID NO: 2596 - DNA, 22 bp, Artificial Sequence
  Synthetic Oligonucleotide
caatttctacttgattgtagat

SEQ ID NO: 2597 - DNA, 22 bp, Artificial Sequence
  Synthetic Oligonucleotide
caatttctacttcggagtagat

SEQ ID NO: 2598 - DNA, 22 bp, Artificial Sequence
  Synthetic Oligonucleotide
gaatttctactggttcgtagat

SEQ ID NO: 2599 - DNA, 21 bp, Artificial Sequence
  Synthetic Oligonucleotide
gaattggttctaagtgagcct

SEQ ID NO: 2600 - DNA, 21 bp, Artificial Sequence
  Synthetic Oligonucleotide
aaattgtgggtaagtctcgtt

SEQ ID NO: 2601 - DNA, 22 bp, Artificial Sequence
  Synthetic Oligonucleotide
aaatttctcctaagagggagat

SEQ ID NO: 2602 - DNA, 21 bp, Artificial Sequence
  Synthetic Oligonucleotide
aaatttctcctatgcggagat

SEQ ID NO: 2603 - DNA, 22 bp, Artificial Sequence
  Synthetic Oligonucleotide
gaatttctactaccgagtagat

SEQ ID NO: 2604 - DNA, 22 bp, Artificial Sequence
  Synthetic Oligonucleotide
caatttctactgataagtagat

SEQ ID NO: 2605 - DNA, 21 bp, Artificial Sequence
  Synthetic Oligonucleotide
caatttctactgtatgtagat

SEQ ID NO: 2606 - DNA, 22 bp, Artificial Sequence
  Synthetic Oligonucleotide
aaatttctcctaatgaggagat

SEQ ID NO: 2607 - DNA, 22 bp, Artificial Sequence
  Synthetic Oligonucleotide
gaatttctactgtcttgtagat

SEQ ID NO: 2608 - DNA, 22 bp, Artificial Sequence
  Synthetic Oligonucleotide
gaatttctactatcgcgtagat

SEQ ID NO: 2609 - DNA, 22 bp, Artificial Sequence
  Synthetic Oligonucleotide
gaatttctacttggatgtagat

SEQ ID NO: 2610 - DNA, 22 bp, Artificial Sequence
  Synthetic Oligonucleotide
gaatttctacactccagtagat

SEQ ID NO: 2611 - DNA, 22 bp, Artificial Sequence
  Synthetic Oligonucleotide
caatttctactttaaggtagat

SEQ ID NO: 2612 - DNA, 20 bp, Artificial Sequence
  Synthetic Oligonucleotide
gaattgggtgtcttcattct

SEQ ID NO: 2613 - DNA, 21 bp, Artificial Sequence
  Synthetic Oligonucleotide
caatttctactttcggtagat

SEQ ID NO: 2614 - DNA, 22 bp, Artificial Sequence
  Synthetic Oligonucleotide
caatttctcctaccgaggagat

SEQ ID NO: 2615 - DNA, 21 bp, Artificial Sequence
  Synthetic Oligonucleotide
gaatttctactatcggtagat

SEQ ID NO: 2616 - DNA, 21 bp, Artificial Sequence
  Synthetic Oligonucleotide
aaattcctactaagtgtgggt

SEQ ID NO: 2617 - DNA, 21 bp, Artificial Sequence
  Synthetic Oligonucleotide
gaatttctaccacaagtagat

SEQ ID NO: 2618 - DNA, 22 bp, Artificial Sequence
  Synthetic Oligonucleotide
caatttctactgccatgtagat

SEQ ID NO: 2619 - DNA, 22 bp, Artificial Sequence
  Synthetic Oligonucleotide
gaatttctacttgtgagtagat

SEQ ID NO: 2620 - DNA, 22 bp, Artificial Sequence
  Synthetic Oligonucleotide
caatttctactctggagtagat

SEQ ID NO: 2621 - DNA, 22 bp, Artificial Sequence
  Synthetic Oligonucleotide
caatttctcctagagaggagat

SEQ ID NO: 2622 - DNA, 20 bp, Artificial Sequence
  Synthetic Oligonucleotide
caatttctactggggtagat

SEQ ID NO: 2623 - DNA, 22 bp, Artificial Sequence
  Synthetic Oligonucleotide
caatttctactcttctgtagat

SEQ ID NO: 2624 - DNA, 22 bp, Artificial Sequence
  Synthetic Oligonucleotide
gaatttctactccgacgtagat

SEQ ID NO: 2625 - DNA, 20 bp, Artificial Sequence
  Synthetic Oligonucleotide
gaattggtggtcttctattt

SEQ ID NO: 2626 - DNA, 21 bp, Artificial Sequence
  Synthetic Oligonucleotide
gaatttctaccctctgtagat

SEQ ID NO: 2627 - DNA, 22 bp, Artificial Sequence
  Synthetic Oligonucleotide
gaatttctacttgaaggtagat

SEQ ID NO: 2628 - DNA, 22 bp, Artificial Sequence
  Synthetic Oligonucleotide
aaatttctactccttggtagat

SEQ ID NO: 2629 - DNA, 21 bp, Artificial Sequence
  Synthetic Oligonucleotide
caatttctacttggagtagat

SEQ ID NO: 2630 - DNA, 22 bp, Artificial Sequence
  Synthetic Oligonucleotide
gaatttctacaatacggtagat

SEQ ID NO: 2631 - DNA, 20 bp, Artificial Sequence
  Synthetic Oligonucleotide
caattgtgcatctttgtgct

SEQ ID NO: 2632 - DNA, 21 bp, Artificial Sequence
  Synthetic Oligonucleotide
caatttagcataagttgctat

SEQ ID NO: 2633 - DNA, 22 bp, Artificial Sequence
  Synthetic Oligonucleotide
aaatttctcctcacgcggagat

SEQ ID NO: 2634 - DNA, 21 bp, Artificial Sequence
  Synthetic Oligonucleotide
aaattggcgctaagtgcgctt

SEQ ID NO: 2635 - DNA, 21 bp, Artificial Sequence
  Synthetic Oligonucleotide
caatttctactgcgtgtagat

SEQ ID NO: 2636 - DNA, 22 bp, Artificial Sequence
  Synthetic Oligonucleotide
caatttctactgcattgtagat

SEQ ID NO: 2637 - DNA, 21 bp, Artificial Sequence
  Synthetic Oligonucleotide
aaattgacactaagtgtgtct

SEQ ID NO: 2638 - DNA, 22 bp, Artificial Sequence
  Synthetic Oligonucleotide
caatttctactcattcgtagat

SEQ ID NO: 2639 - DNA, 20 bp, Artificial Sequence
  Synthetic Oligonucleotide
caattagctttcttaagttt

SEQ ID NO: 2640 - DNA, 22 bp, Artificial Sequence
  Synthetic Oligonucleotide
aaatttctcctacgctggagat

SEQ ID NO: 2641 - DNA, 22 bp, Artificial Sequence
  Synthetic Oligonucleotide
caatttctactttcacgtagat

SEQ ID NO: 2642 - DNA, 22 bp, Artificial Sequence
  Synthetic Oligonucleotide
aaatttctactacgttgtagat

SEQ ID NO: 2643 - DNA, 20 bp, Artificial Sequence
  Synthetic Oligonucleotide
gaattgtgtatctttgtgct

SEQ ID NO: 2644 - DNA, 22 bp, Artificial Sequence
  Synthetic Oligonucleotide
aaatttctactagtgcgtagat

SEQ ID NO: 2645 - DNA, 21 bp, Artificial Sequence
  Synthetic Oligonucleotide
caatttctactctttgtagat

SEQ ID NO: 2646 - DNA, 20 bp, Artificial Sequence
  Synthetic Oligonucleotide
caatttgtgttcttgtacgt

SEQ ID NO: 2647 - DNA, 22 bp, Artificial Sequence
  Synthetic Oligonucleotide
caatttctactgccgtgtagat

SEQ ID NO: 2648 - DNA, 22 bp, Artificial Sequence
  Synthetic Oligonucleotide
caatttctactttatagtagat

SEQ ID NO: 2649 - DNA, 22 bp, Artificial Sequence
  Synthetic Oligonucleotide
caatttctactgcactgtagat

SEQ ID NO: 2650 - DNA, 22 bp, Artificial Sequence
  Synthetic Oligonucleotide
gaatttctacttacaggtagat

SEQ ID NO: 2651 - DNA, 21 bp, Artificial Sequence
  Synthetic Oligonucleotide
gaattaggtctaagtggcttt

SEQ ID NO: 2652 - DNA, 20 bp, Artificial Sequence
  Synthetic Oligonucleotide
caatttctactaacgtagat

SEQ ID NO: 2653 - DNA, 22 bp, Artificial Sequence
  Synthetic Oligonucleotide
gaatttctactcgttggtagat

SEQ ID NO: 2654 - DNA, 20 bp, Artificial Sequence
  Synthetic Oligonucleotide
caattctgattcttgtcggt

SEQ ID NO: 2655 - DNA, 22 bp, Artificial Sequence
  Synthetic Oligonucleotide
caatttctactccggtgtagat

SEQ ID NO: 2656 - DNA, 22 bp, Artificial Sequence
  Synthetic Oligonucleotide
caatttctactccctcgtagat

SEQ ID NO: 2657 - DNA, 22 bp, Artificial Sequence
  Synthetic Oligonucleotide
caatttctactagtgcgtagat

SEQ ID NO: 2658 - DNA, 20 bp, Artificial Sequence
  Synthetic Oligonucleotide
caattgctcgtcttcgagct

SEQ ID NO: 2659 - DNA, 22 bp, Artificial Sequence
  Synthetic Oligonucleotide
caatttctacatcaccgtagat

SEQ ID NO: 2660 - DNA, 22 bp, Artificial Sequence
  Synthetic Oligonucleotide
aaatttctacttcaaggtagat

SEQ ID NO: 2661 - DNA, 22 bp, Artificial Sequence
  Synthetic Oligonucleotide
caatttctactatgtggtagat

SEQ ID NO: 2662 - DNA, 21 bp, Artificial Sequence
  Synthetic Oligonucleotide
gaatttctactcgtagtagat

SEQ ID NO: 2663 - DNA, 22 bp, Artificial Sequence
  Synthetic Oligonucleotide
caatttctactctcacgtagat

SEQ ID NO: 2664 - DNA, 22 bp, Artificial Sequence
  Synthetic Oligonucleotide
caatttctacttacgagtagat

SEQ ID NO: 2665 - DNA, 21 bp, Artificial Sequence
  Synthetic Oligonucleotide
gaatttctactatccgtagat

SEQ ID NO: 2666 - DNA, 21 bp, Artificial Sequence
  Synthetic Oligonucleotide
gaatttctactacacgtagat

SEQ ID NO: 2667 - DNA, 22 bp, Artificial Sequence
  Synthetic Oligonucleotide
caatttctactgtgcagtagat

SEQ ID NO: 2668 - DNA, 22 bp, Artificial Sequence
  Synthetic Oligonucleotide
caatttctactcccgtgtagat

SEQ ID NO: 2669 - DNA, 21 bp, Artificial Sequence
  Synthetic Oligonucleotide
caatttctacttcgcgtagat

SEQ ID NO: 2670 - DNA, 21 bp, Artificial Sequence
  Synthetic Oligonucleotide
caatttctcctacgcggagat

SEQ ID NO: 2671 - DNA, 21 bp, Artificial Sequence
  Synthetic Oligonucleotide
caatttctactagctgtagat

SEQ ID NO: 2672 - DNA, 22 bp, Artificial Sequence
  Synthetic Oligonucleotide
gaatttctacctacttgtagat

SEQ ID NO: 2673 - DNA, 22 bp, Artificial Sequence
  Synthetic Oligonucleotide
aaatttctacgttacggtagat

SEQ ID NO: 2674 - DNA, 22 bp, Artificial Sequence
  Synthetic Oligonucleotide
gaatttctactgattcgtagat

SEQ ID NO: 2675 - DNA, 22 bp, Artificial Sequence
  Synthetic Oligonucleotide
caatttctacttgccggtagat

SEQ ID NO: 2676 - DNA, 21 bp, Artificial Sequence
  Synthetic Oligonucleotide
gaatttctcctacggggagat

SEQ ID NO: 2677 - DNA, 22 bp, Artificial Sequence
  Synthetic Oligonucleotide
gaatttctacttggaggtagat

SEQ ID NO: 2678 - DNA, 22 bp, Artificial Sequence
  Synthetic Oligonucleotide
gaatttctactgcggtgtagat

SEQ ID NO: 2679 - DNA, 21 bp, Artificial Sequence
  Synthetic Oligonucleotide
caatttctaataagtttagat

SEQ ID NO: 2680 - DNA, 22 bp, Artificial Sequence
  Synthetic Oligonucleotide
aaatttctacacgagtgtagat

SEQ ID NO: 2681 - DNA, 21 bp, Artificial Sequence
  Synthetic Oligonucleotide
caattcgttgtaagttaacgt

SEQ ID NO: 2682 - DNA, 22 bp, Artificial Sequence
  Synthetic Oligonucleotide
aaatttctactgttgagtagat

SEQ ID NO: 2683 - DNA, 22 bp, Artificial Sequence
  Synthetic Oligonucleotide
caatttctactcgtatgtagat

SEQ ID NO: 2684 - DNA, 22 bp, Artificial Sequence
  Synthetic Oligonucleotide
caatttctacttcctggtagat

SEQ ID NO: 2685 - DNA, 22 bp, Artificial Sequence
  Synthetic Oligonucleotide
aaatttctactacacggtagat

SEQ ID NO: 2686 - DNA, 22 bp, Artificial Sequence
  Synthetic Oligonucleotide
caatttctacttaagagtagat

SEQ ID NO: 2687 - DNA, 21 bp, Artificial Sequence
  Synthetic Oligonucleotide
caattatgtttaagtaacgtt

SEQ ID NO: 2688 - DNA, 22 bp, Artificial Sequence
  Synthetic Oligonucleotide
gaatttctcctacagcggagat

SEQ ID NO: 2689 - DNA, 21 bp, Artificial Sequence
  Synthetic Oligonucleotide
caatttctactggcggtagat

SEQ ID NO: 2690 - DNA, 22 bp, Artificial Sequence
  Synthetic Oligonucleotide
gaatttctactatgcggtagat

SEQ ID NO: 2691 - DNA, 22 bp, Artificial Sequence
  Synthetic Oligonucleotide
caatttctactgggatgtagat

SEQ ID NO: 2692 - DNA, 22 bp, Artificial Sequence
  Synthetic Oligonucleotide
caatttctactctcaagtagat

SEQ ID NO: 2693 - DNA, 21 bp, Artificial Sequence
  Synthetic Oligonucleotide
caattacggttaagtgtcgtt

SEQ ID NO: 2694 - DNA, 22 bp, Artificial Sequence
  Synthetic Oligonucleotide
caatttctacttacgtgtagat

SEQ ID NO: 2695 - DNA, 21 bp, Artificial Sequence
  Synthetic Oligonucleotide
caattgctggtaagtctagct

SEQ ID NO: 2696 - DNA, 21 bp, Artificial Sequence
  Synthetic Oligonucleotide
caattggcgctaagtgcgcct

SEQ ID NO: 2697 - DNA, 22 bp, Artificial Sequence
  Synthetic Oligonucleotide
caatttctacttctcagtagat

SEQ ID NO: 2698 - DNA, 22 bp, Artificial Sequence
  Synthetic Oligonucleotide
caatttctactagtaagtagat

SEQ ID NO: 2699 - DNA, 22 bp, Artificial Sequence
  Synthetic Oligonucleotide
caatttctactagcctgtagat

SEQ ID NO: 2700 - DNA, 22 bp, Artificial Sequence
  Synthetic Oligonucleotide
caatttctccgaatcgggagat

SEQ ID NO: 2701 - DNA, 20 bp, Artificial Sequence
  Synthetic Oligonucleotide
gaatttctactggcgtagat

SEQ ID NO: 2702 - DNA, 20 bp, Artificial Sequence
  Synthetic Oligonucleotide
caattgttcgtcttcgagtt

SEQ ID NO: 2703 - DNA, 21 bp, Artificial Sequence
  Synthetic Oligonucleotide
caatttctactggatgtagat

SEQ ID NO: 2704 - DNA, 22 bp, Artificial Sequence
  Synthetic Oligonucleotide
caatttctactaaagagtagat

SEQ ID NO: 2705 - DNA, 20 bp, Artificial Sequence
  Synthetic Oligonucleotide
gaattggtcatctttggtct

SEQ ID NO: 2706 - DNA, 21 bp, Artificial Sequence
  Synthetic Oligonucleotide
caatttctactccttgtagat

SEQ ID NO: 2707 - DNA, 21 bp, Artificial Sequence
  Synthetic Oligonucleotide
gaatttctacttgctgtagat

SEQ ID NO: 2708 - DNA, 21 bp, Artificial Sequence
  Synthetic Oligonucleotide
gaatttctactgcatgtagat

SEQ ID NO: 2709 - DNA, 22 bp, Artificial Sequence
  Synthetic Oligonucleotide
caatttctacttcgctgtagat

SEQ ID NO: 2710 - DNA, 22 bp, Artificial Sequence
  Synthetic Oligonucleotide
caatttctactatggcgtagat

SEQ ID NO: 2711 - DNA, 22 bp, Artificial Sequence
  Synthetic Oligonucleotide
caatttctactcaggagtagat

SEQ ID NO: 2712 - DNA, 22 bp, Artificial Sequence
  Synthetic Oligonucleotide
gaatttctacaacggtgtagat

SEQ ID NO: 2713 - DNA, 20 bp, Artificial Sequence
  Synthetic Oligonucleotide
caattcgctgtcttcagcgt

SEQ ID NO: 2714 - DNA, 22 bp, Artificial Sequence
  Synthetic Oligonucleotide
gaatttctactgttacgtagat

SEQ ID NO: 2715 - DNA, 21 bp, Artificial Sequence
  Synthetic Oligonucleotide
caattgtgcgtaagttgcgtt

SEQ ID NO: 2716 - DNA, 21 bp, Artificial Sequence
  Synthetic Oligonucleotide
caattgttgataagtttgact

SEQ ID NO: 2717 - DNA, 22 bp, Artificial Sequence
  Synthetic Oligonucleotide
gaatttctactcctaagtagat

SEQ ID NO: 2718 - DNA, 21 bp, Artificial Sequence
  Synthetic Oligonucleotide
caatttctacatttagtagat

SEQ ID NO: 2719 - DNA, 20 bp, Artificial Sequence
  Synthetic Oligonucleotide
caattcgtcgtcttcgacgt

SEQ ID NO: 2720 - DNA, 20 bp, Artificial Sequence
  Synthetic Oligonucleotide
caattggttatctttgatct

SEQ ID NO: 2721 - DNA, 22 bp, Artificial Sequence
  Synthetic Oligonucleotide
gaatttctactatgttgtagat

SEQ ID NO: 2722 - DNA, 22 bp, Artificial Sequence
  Synthetic Oligonucleotide
caatttctacttacaggtagat

SEQ ID NO: 2723 - DNA, 20 bp, Artificial Sequence
  Synthetic Oligonucleotide
caattcatcttcttaggtgt

SEQ ID NO: 2724 - DNA, 21 bp, Artificial Sequence
  Synthetic Oligonucleotide
gaatttctactcctggtagat

SEQ ID NO: 2725 - DNA, 22 bp, Artificial Sequence
  Synthetic Oligonucleotide
caatttctactacagggtagat

SEQ ID NO: 2726 - DNA, 21 bp, Artificial Sequence
  Synthetic Oligonucleotide
caatttctccggttaggagat

SEQ ID NO: 2727 - DNA, 20 bp, Artificial Sequence
  Synthetic Oligonucleotide
gaattcgtcgtctttgatgt

SEQ ID NO: 2728 - DNA, 22 bp, Artificial Sequence
  Synthetic Oligonucleotide
caatttctactaccctgtagat

SEQ ID NO: 2729 - DNA, 20 bp, Artificial Sequence
  Synthetic Oligonucleotide
caattggcggtcttccgtct

SEQ ID NO: 2730 - DNA, 22 bp, Artificial Sequence
  Synthetic Oligonucleotide
gaatttctactcgcttgtagat

SEQ ID NO: 2731 - DNA, 20 bp, Artificial Sequence
  Synthetic Oligonucleotide
gaattactcgtcttcgagtt

SEQ ID NO: 2732 - DNA, 22 bp, Artificial Sequence
  Synthetic Oligonucleotide
caatttctactaagatgtagat

SEQ ID NO: 2733 - DNA, 22 bp, Artificial Sequence
  Synthetic Oligonucleotide
caatttctactgtctcgtagat

SEQ ID NO: 2734 - DNA, 22 bp, Artificial Sequence
  Synthetic Oligonucleotide
aaatttctacttaagcgtagat

SEQ ID NO: 2735 - DNA, 22 bp, Artificial Sequence
  Synthetic Oligonucleotide
caatttctactagtcagtagat

SEQ ID NO: 2736 - DNA, 20 bp, Artificial Sequence
  Synthetic Oligonucleotide
caattggttctcttggactt

SEQ ID NO: 2737 - DNA, 20 bp, Artificial Sequence
  Synthetic Oligonucleotide
caattatacttcttagtgtt

SEQ ID NO: 2738 - DNA, 21 bp, Artificial Sequence
  Synthetic Oligonucleotide
caatttctactgtgcgtagat

SEQ ID NO: 2739 - DNA, 22 bp, Artificial Sequence
  Synthetic Oligonucleotide
gaatttctactatggtgtagat

SEQ ID NO: 2740 - DNA, 20 bp, Artificial Sequence
  Synthetic Oligonucleotide
caattgcttgtctttgggct

SEQ ID NO: 2741 - DNA, 20 bp, Artificial Sequence
  Synthetic Oligonucleotide
caatttctactagcgtagat

SEQ ID NO: 2742 - DNA, 20 bp, Artificial Sequence
  Synthetic Oligonucleotide
gaattggtggtctttcgcct

SEQ ID NO: 2743 - DNA, 20 bp, Artificial Sequence
  Synthetic Oligonucleotide
caattggggttcttatctct

SEQ ID NO: 2744 - DNA, 21 bp, Artificial Sequence
  Synthetic Oligonucleotide
aaatttctactaggggtagat

SEQ ID NO: 2745 - DNA, 22 bp, Artificial Sequence
  Synthetic Oligonucleotide
caatttctactacgttgtagat

SEQ ID NO: 2746 - DNA, 22 bp, Artificial Sequence
  Synthetic Oligonucleotide
caatttctactcttgagtagat

SEQ ID NO: 2747 - DNA, 22 bp, Artificial Sequence
  Synthetic Oligonucleotide
caatttctacgttggtgtagat

SEQ ID NO: 2748 - DNA, 21 bp, Artificial Sequence
  Synthetic Oligonucleotide
gaatttctacttcatgtagat

SEQ ID NO: 2749 - DNA, 20 bp, Artificial Sequence
  Synthetic Oligonucleotide
caattgtttttcttggagtt

SEQ ID NO: 2750 - DNA, 22 bp, Artificial Sequence
  Synthetic Oligonucleotide
caatttctacttcaacgtagat

SEQ ID NO: 2751 - DNA, 22 bp, Artificial Sequence
  Synthetic Oligonucleotide
gaatttctactcaatcgtagat

SEQ ID NO: 2752 - DNA, 22 bp, Artificial Sequence
  Synthetic Oligonucleotide
gaatttctactactctgtagat

SEQ ID NO: 2753 - DNA, 22 bp, Artificial Sequence
  Synthetic Oligonucleotide
gaatttctactagagtgtagat

SEQ ID NO: 2754 - DNA, 22 bp, Artificial Sequence
  Synthetic Oligonucleotide
aaatttctccccgagcggagat

SEQ ID NO: 2755 - DNA, 21 bp, Artificial Sequence
  Synthetic Oligonucleotide
gaatttctcctgggcggagat

SEQ ID NO: 2756 - DNA, 21 bp, Artificial Sequence
  Synthetic Oligonucleotide
gaattacgcttaagtggcgtt

SEQ ID NO: 2757 - DNA, 22 bp, Artificial Sequence
  Synthetic Oligonucleotide
caatttctacttcggcgtagat

SEQ ID NO: 2758 - DNA, 22 bp, Artificial Sequence
  Synthetic Oligonucleotide
caatttctacttatgggtagat

SEQ ID NO: 2759 - DNA, 21 bp, Artificial Sequence
  Synthetic Oligonucleotide
caatttctactgtccgtagat

SEQ ID NO: 2760 - DNA, 20 bp, Artificial Sequence
  Synthetic Oligonucleotide
caattgggtttcttggcttt

SEQ ID NO: 2761 - DNA, 20 bp, Artificial Sequence
  Synthetic Oligonucleotide
caattggtgttcttgtattt

SEQ ID NO: 2762 - DNA, 20 bp, Artificial Sequence
  Synthetic Oligonucleotide
caatttctactccagtagat

SEQ ID NO: 2763 - DNA, 21 bp, Artificial Sequence
  Synthetic Oligonucleotide
caattacgtttaagtggcgtt

SEQ ID NO: 2764 - DNA, 21 bp, Artificial Sequence
  Synthetic Oligonucleotide
aaatttctacttcgcgtagat

SEQ ID NO: 2765 - DNA, 22 bp, Artificial Sequence
  Synthetic Oligonucleotide
caatttctacttacctgtagat

SEQ ID NO: 2766 - DNA, 21 bp, Artificial Sequence
  Synthetic Oligonucleotide
caatttctactgctcgtagat

SEQ ID NO: 2767 - DNA, 22 bp, Artificial Sequence
  Synthetic Oligonucleotide
caatttctacttacgggtagat

SEQ ID NO: 2768 - DNA, 22 bp, Artificial Sequence
  Synthetic Oligonucleotide
caatttctactttcgagtagat

SEQ ID NO: 2769 - DNA, 20 bp, Artificial Sequence
  Synthetic Oligonucleotide
caattggtattcttgtacct

SEQ ID NO: 2770 - DNA, 20 bp, Artificial Sequence
  Synthetic Oligonucleotide
caattcacgttcttatgtgt

SEQ ID NO: 2771 - DNA, 20 bp, Artificial Sequence
  Synthetic Oligonucleotide
gaattccctctcttgggggt

SEQ ID NO: 2772 - DNA, 21 bp, Artificial Sequence
  Synthetic Oligonucleotide
caatttctactaaccgtagat

SEQ ID NO: 2773 - DNA, 22 bp, Artificial Sequence
  Synthetic Oligonucleotide
caatttctccctctacggagat

SEQ ID NO: 2774 - DNA, 22 bp, Artificial Sequence
  Synthetic Oligonucleotide
gaatttctcccgtctgggagat

SEQ ID NO: 2775 - DNA, 22 bp, Artificial Sequence
  Synthetic Oligonucleotide
gaatttctacagcccggtagat

SEQ ID NO: 2776 - DNA, 22 bp, Artificial Sequence
  Synthetic Oligonucleotide
gaatttctactaatgggtagat

SEQ ID NO: 2777 - DNA, 20 bp, Artificial Sequence
  Synthetic Oligonucleotide
gaatttctacttcggtagat

SEQ ID NO: 2778 - DNA, 22 bp, Artificial Sequence
  Synthetic Oligonucleotide
caatttctactgggcagtagat

SEQ ID NO: 2779 - DNA, 21 bp, Artificial Sequence
  Synthetic Oligonucleotide
caattactcctaagtggggtt

SEQ ID NO: 2780 - DNA, 22 bp, Artificial Sequence
  Synthetic Oligonucleotide
caatttctactgttcagtagat

SEQ ID NO: 2781 - DNA, 20 bp, Artificial Sequence
  Synthetic Oligonucleotide
caattgcgtgtctttgtgct

SEQ ID NO: 2782 - DNA, 22 bp, Artificial Sequence
  Synthetic Oligonucleotide
gaatttctaccggtcggtagat

SEQ ID NO: 2783 - DNA, 21 bp, Artificial Sequence
  Synthetic Oligonucleotide
caattggttctaagtgggttt

SEQ ID NO: 2784 - DNA, 21 bp, Artificial Sequence
  Synthetic Oligonucleotide
aaatttctacctgtcgtagat

SEQ ID NO: 2785 - DNA, 21 bp, Artificial Sequence
  Synthetic Oligonucleotide
caatttctactaccggtagat

SEQ ID NO: 2786 - DNA, 21 bp, Artificial Sequence
  Synthetic Oligonucleotide
caatttctactcgtcgtagat

SEQ ID NO: 2787 - DNA, 20 bp, Artificial Sequence
  Synthetic Oligonucleotide
caatttatcttcttggatat

SEQ ID NO: 2788 - DNA, 21 bp, Artificial Sequence
  Synthetic Oligonucleotide
caattccgactaagtgtcggt

SEQ ID NO: 2789 - DNA, 21 bp, Artificial Sequence
  Synthetic Oligonucleotide
gaatttctactcgtggtagat

SEQ ID NO: 2790 - DNA, 21 bp, Artificial Sequence
  Synthetic Oligonucleotide
aaatttctcctaaatggagat

SEQ ID NO: 2791 - DNA, 21 bp, Artificial Sequence
  Synthetic Oligonucleotide
caattattattaagtgtggtt

SEQ ID NO: 2792 - DNA, 20 bp, Artificial Sequence
  Synthetic Oligonucleotide
gaattccaggtcttcctggt

SEQ ID NO: 2793 - DNA, 22 bp, Artificial Sequence
  Synthetic Oligonucleotide
gaatttctacctgttggtagat

SEQ ID NO: 2794 - DNA, 22 bp, Artificial Sequence
  Synthetic Oligonucleotide
caatttctactgttccgtagat

SEQ ID NO: 2795 - DNA, 21 bp, Artificial Sequence
  Synthetic Oligonucleotide
caattaccattaagtatggtt

SEQ ID NO: 2796 - DNA, 21 bp, Artificial Sequence
  Synthetic Oligonucleotide
caatttctacttgcggtagat

SEQ ID NO: 2797 - DNA, 21 bp, Artificial Sequence
  Synthetic Oligonucleotide
gaatttctactgtcggtagat

SEQ ID NO: 2798 - DNA, 22 bp, Artificial Sequence
  Synthetic Oligonucleotide
caatttctacttggatgtagat

SEQ ID NO: 2799 - DNA, 22 bp, Artificial Sequence
  Synthetic Oligonucleotide
gaatttctactagtttgtagat

SEQ ID NO: 2800 - DNA, 21 bp, Artificial Sequence
  Synthetic Oligonucleotide
caatttctactgggcgtagat

SEQ ID NO: 2801 - DNA, 21 bp, Artificial Sequence
  Synthetic Oligonucleotide
gaattcgagctaagtgtttgt

SEQ ID NO: 2802 - DNA, 21 bp, Artificial Sequence
  Synthetic Oligonucleotide
gaatttcgcctaagtggcgat

SEQ ID NO: 2803 - DNA, 21 bp, Artificial Sequence
  Synthetic Oligonucleotide
gaattgcgtctaagtggtgtt

SEQ ID NO: 2804 - DNA, 21 bp, Artificial Sequence
  Synthetic Oligonucleotide
caatttctacttagagtagat

SEQ ID NO: 2805 - DNA, 21 bp, Artificial Sequence
  Synthetic Oligonucleotide
caatttctcctgagtggagat

SEQ ID NO: 2806 - DNA, 22 bp, Artificial Sequence
  Synthetic Oligonucleotide
aaatttctactctagcgtagat

SEQ ID NO: 2807 - DNA, 22 bp, Artificial Sequence
  Synthetic Oligonucleotide
caatttctactggagagtagat

SEQ ID NO: 2808 - DNA, 20 bp, Artificial Sequence
  Synthetic Oligonucleotide
aaattcgtcgtcttcggcgt

SEQ ID NO: 2809 - DNA, 21 bp, Artificial Sequence
  Synthetic Oligonucleotide
caatttctcctagggggagat

SEQ ID NO: 2810 - DNA, 22 bp, Artificial Sequence
  Synthetic Oligonucleotide
gaatttctactcccttgtagat

SEQ ID NO: 2811 - DNA, 20 bp, Artificial Sequence
  Synthetic Oligonucleotide
caattggttctcttgggctt

SEQ ID NO: 2812 - DNA, 20 bp, Artificial Sequence
  Synthetic Oligonucleotide
caattccgcatctttgcggt

SEQ ID NO: 2813 - DNA, 21 bp, Artificial Sequence
  Synthetic Oligonucleotide
caatttctacatgctgtagat

SEQ ID NO: 2814 - DNA, 21 bp, Artificial Sequence
  Synthetic Oligonucleotide
caattgttcttaagtagaact

SEQ ID NO: 2815 - DNA, 20 bp, Artificial Sequence
  Synthetic Oligonucleotide
caattttgcatctttgtgat

SEQ ID NO: 2816 - DNA, 22 bp, Artificial Sequence
  Synthetic Oligonucleotide
caatttctcctcataaggagat

SEQ ID NO: 2817 - DNA, 21 bp, Artificial Sequence
  Synthetic Oligonucleotide
caatttctactacccgtagat

SEQ ID NO: 2818 - DNA, 21 bp, Artificial Sequence
  Synthetic Oligonucleotide
gaattcgcattaagtgtgtgt

SEQ ID NO: 2819 - DNA, 20 bp, Artificial Sequence
  Synthetic Oligonucleotide
aaattcgtgttcttacgcgt

SEQ ID NO: 2820 - DNA, 22 bp, Artificial Sequence
  Synthetic Oligonucleotide
caatttctactcgagcgtagat

SEQ ID NO: 2821 - DNA, 21 bp, Artificial Sequence
  Synthetic Oligonucleotide
caattacgactaagtgttgtt

SEQ ID NO: 2822 - DNA, 22 bp, Artificial Sequence
  Synthetic Oligonucleotide
caatttctcctatggaggagat

SEQ ID NO: 2823 - DNA, 21 bp, Artificial Sequence
  Synthetic Oligonucleotide
caatttaacgtaagtcgttgt

SEQ ID NO: 2824 - DNA, 22 bp, Artificial Sequence
  Synthetic Oligonucleotide
gaatttctacattccagtagat

SEQ ID NO: 2825 - DNA, 22 bp, Artificial Sequence
  Synthetic Oligonucleotide
caatttctactacgacgtagat

SEQ ID NO: 2826 - DNA, 22 bp, Artificial Sequence
  Synthetic Oligonucleotide
caatttctactcagacgtagat

SEQ ID NO: 2827 - DNA, 22 bp, Artificial Sequence
  Synthetic Oligonucleotide
gaatttctactctactgtagat

SEQ ID NO: 2828 - DNA, 22 bp, Artificial Sequence
  Synthetic Oligonucleotide
caatttctactctcccgtagat

SEQ ID NO: 2829 - DNA, 21 bp, Artificial Sequence
  Synthetic Oligonucleotide
caattggatttaagtggtcct

SEQ ID NO: 2830 - DNA, 22 bp, Artificial Sequence
  Synthetic Oligonucleotide
aaatttctactggactgtagat

SEQ ID NO: 2831 - DNA, 20 bp, Artificial Sequence
  Synthetic Oligonucleotide
caattgcacgtcttcgtgct

SEQ ID NO: 2832 - DNA, 21 bp, Artificial Sequence
  Synthetic Oligonucleotide
caattgatgctaagtgcatct

SEQ ID NO: 2833 - DNA, 20 bp, Artificial Sequence
  Synthetic Oligonucleotide
caattcgctgtcttcggtgt

SEQ ID NO: 2834 - DNA, 22 bp, Artificial Sequence
  Synthetic Oligonucleotide
caatttctactacgtcgtagat

SEQ ID NO: 2835 - DNA, 21 bp, Artificial Sequence
  Synthetic Oligonucleotide
caatttctccggcagggagat

SEQ ID NO: 2836 - DNA, 20 bp, Artificial Sequence
  Synthetic Oligonucleotide
caatttctccacgcggagat

SEQ ID NO: 2837 - DNA, 20 bp, Artificial Sequence
  Synthetic Oligonucleotide
gaattgacgctcttgcgttt

SEQ ID NO: 2838 - DNA, 20 bp, Artificial Sequence
  Synthetic Oligonucleotide
caattactcttcttggggtt

SEQ ID NO: 2839 - DNA, 22 bp, Artificial Sequence
  Synthetic Oligonucleotide
caatttctactaccgggtagat

SEQ ID NO: 2840 - DNA, 22 bp, Artificial Sequence
  Synthetic Oligonucleotide
caatttctactcatcagtagat

SEQ ID NO: 2841 - DNA, 22 bp, Artificial Sequence
  Synthetic Oligonucleotide
gaatttctcctactttggagat

SEQ ID NO: 2842 - DNA, 22 bp, Artificial Sequence
  Synthetic Oligonucleotide
gaatttctcccacctaggagat

SEQ ID NO: 2843 - DNA, 21 bp, Artificial Sequence
  Synthetic Oligonucleotide
gaatttctactgagagtagat

SEQ ID NO: 2844 - DNA, 21 bp, Artificial Sequence
  Synthetic Oligonucleotide
gaatttctacgtctcgtagat

SEQ ID NO: 2845 - DNA, 21 bp, Artificial Sequence
  Synthetic Oligonucleotide
aaattgcgtctaagtggcgtt

SEQ ID NO: 2846 - DNA, 21 bp, Artificial Sequence
  Synthetic Oligonucleotide
caatttctacgcgaagtagat

SEQ ID NO: 2847 - DNA, 21 bp, Artificial Sequence
  Synthetic Oligonucleotide
caattgcaggtaagtcttgtt

SEQ ID NO: 2848 - DNA, 22 bp, Artificial Sequence
  Synthetic Oligonucleotide
gaatttctactcccctgtagat

SEQ ID NO: 2849 - DNA, 22 bp, Artificial Sequence
  Synthetic Oligonucleotide
caatttctacttccgggtagat

SEQ ID NO: 2850 - DNA, 22 bp, Artificial Sequence
  Synthetic Oligonucleotide
gaatttctactccactgtagat

SEQ ID NO: 2851 - DNA, 21 bp, Artificial Sequence
  Synthetic Oligonucleotide
caattgcgagtaagtcttgtt

SEQ ID NO: 2852 - DNA, 20 bp, Artificial Sequence
  Synthetic Oligonucleotide
caattgtgtttcttgacact

SEQ ID NO: 2853 - DNA, 21 bp, Artificial Sequence
  Synthetic Oligonucleotide
caatttctacgcccggtagat

SEQ ID NO: 2854 - DNA, 21 bp, Artificial Sequence
  Synthetic Oligonucleotide
gaatttctactccctgtagat

SEQ ID NO: 2855 - DNA, 22 bp, Artificial Sequence
  Synthetic Oligonucleotide
caatttctacttgtgagtagat

SEQ ID NO: 2856 - DNA, 22 bp, Artificial Sequence
  Synthetic Oligonucleotide
caatttctactggcgtgtagat

SEQ ID NO: 2857 - DNA, 21 bp, Artificial Sequence
  Synthetic Oligonucleotide
caattgccggtaagtccggtt

SEQ ID NO: 2858 - DNA, 20 bp, Artificial Sequence
  Synthetic Oligonucleotide
gaattgctgctcttgtggct

SEQ ID NO: 2859 - DNA, 22 bp, Artificial Sequence
  Synthetic Oligonucleotide
caatttctcctaaagcggagat

SEQ ID NO: 2860 - DNA, 22 bp, Artificial Sequence
  Synthetic Oligonucleotide
caatttctactaccgtgtagat

SEQ ID NO: 2861 - DNA, 22 bp, Artificial Sequence
  Synthetic Oligonucleotide
caatttctcctatgttggagat

SEQ ID NO: 2862 - DNA, 22 bp, Artificial Sequence
  Synthetic Oligonucleotide
gaatttctacttgtgggtagat

SEQ ID NO: 2863 - DNA, 21 bp, Artificial Sequence
  Synthetic Oligonucleotide
caattgctgttaagtgcggct

SEQ ID NO: 2864 - DNA, 20 bp, Artificial Sequence
  Synthetic Oligonucleotide
gaattggtggtcttccactt

SEQ ID NO: 2865 - DNA, 21 bp, Artificial Sequence
  Synthetic Oligonucleotide
caatttctcctgcgtggagat

SEQ ID NO: 2866 - DNA, 20 bp, Artificial Sequence
  Synthetic Oligonucleotide
caatttcgggtctttctggt

SEQ ID NO: 2867 - DNA, 22 bp, Artificial Sequence
  Synthetic Oligonucleotide
caatttctactgccacgtagat

SEQ ID NO: 2868 - DNA, 22 bp, Artificial Sequence
  Synthetic Oligonucleotide
caatttctactagacggtagat

SEQ ID NO: 2869 - DNA, 21 bp, Artificial Sequence
  Synthetic Oligonucleotide
caatttctactctccgtagat

SEQ ID NO: 2870 - DNA, 21 bp, Artificial Sequence
  Synthetic Oligonucleotide
aaatttctactactggtagat

SEQ ID NO: 2871 - DNA, 22 bp, Artificial Sequence
  Synthetic Oligonucleotide
aaatttctacttgagcgtagat

SEQ ID NO: 2872 - DNA, 20 bp, Artificial Sequence
  Synthetic Oligonucleotide
caattgttgctcttgcggtt

SEQ ID NO: 2873 - DNA, 21 bp, Artificial Sequence
  Synthetic Oligonucleotide
caattagtcttaagtaggttt

SEQ ID NO: 2874 - DNA, 22 bp, Artificial Sequence
  Synthetic Oligonucleotide
caatttctacttctgggtagat

SEQ ID NO: 2875 - DNA, 21 bp, Artificial Sequence
  Synthetic Oligonucleotide
gaatttctaccaacggtagat

SEQ ID NO: 2876 - DNA, 21 bp, Artificial Sequence
  Synthetic Oligonucleotide
caattggttataagttaatct

SEQ ID NO: 2877 - DNA, 22 bp, Artificial Sequence
  Synthetic Oligonucleotide
gaatttctactctatcgtagat

SEQ ID NO: 2878 - DNA, 20 bp, Artificial Sequence
  Synthetic Oligonucleotide
caattactgatctttcggtt

SEQ ID NO: 2879 - DNA, 22 bp, Artificial Sequence
  Synthetic Oligonucleotide
caatttctcctacggtggagat

SEQ ID NO: 2880 - DNA, 22 bp, Artificial Sequence
  Synthetic Oligonucleotide
gaatttctactaccgcgtagat

SEQ ID NO: 2881 - DNA, 22 bp, Artificial Sequence
  Synthetic Oligonucleotide
caatttctactctgatgtagat

SEQ ID NO: 2882 - DNA, 22 bp, Artificial Sequence
  Synthetic Oligonucleotide
caatttctactgtggggtagat

SEQ ID NO: 2883 - DNA, 22 bp, Artificial Sequence
  Synthetic Oligonucleotide
gaatttctccagcccaggagat

SEQ ID NO: 2884 - DNA, 22 bp, Artificial Sequence
  Synthetic Oligonucleotide
caatttctacttttatgtagat

SEQ ID NO: 2885 - DNA, 20 bp, Artificial Sequence
  Synthetic Oligonucleotide
caattttgtgtcttcgcggt

SEQ ID NO: 2886 - DNA, 20 bp, Artificial Sequence
  Synthetic Oligonucleotide
gaatttctactagcgtagat

SEQ ID NO: 2887 - DNA, 21 bp, Artificial Sequence
  Synthetic Oligonucleotide
caattttccataagttggagt

SEQ ID NO: 2888 - DNA, 22 bp, Artificial Sequence
  Synthetic Oligonucleotide
caatttctacttagtggtagat

SEQ ID NO: 2889 - DNA, 22 bp, Artificial Sequence
  Synthetic Oligonucleotide
gaatttctaccgtagagtagat

SEQ ID NO: 2890 - DNA, 20 bp, Artificial Sequence
  Synthetic Oligonucleotide
caattgatgatctttcattt

SEQ ID NO: 2891 - DNA, 20 bp, Artificial Sequence
  Synthetic Oligonucleotide
caattgcgtctcttgacgtt

SEQ ID NO: 2892 - DNA, 20 bp, Artificial Sequence
  Synthetic Oligonucleotide
caattggtggtcttccactt

SEQ ID NO: 2893 - DNA, 21 bp, Artificial Sequence
  Synthetic Oligonucleotide
caatttctactgaatgtagat

SEQ ID NO: 2894 - DNA, 20 bp, Artificial Sequence
  Synthetic Oligonucleotide
caatttctactgttgtagat

SEQ ID NO: 2895 - DNA, 21 bp, Artificial Sequence
  Synthetic Oligonucleotide
aaatttctactcatagtagat

SEQ ID NO: 2896 - DNA, 20 bp, Artificial Sequence
  Synthetic Oligonucleotide
caattggtcttcttagattt

SEQ ID NO: 2897 - DNA, 21 bp, Artificial Sequence
  Synthetic Oligonucleotide
gaatttctcccacctggagat

SEQ ID NO: 2898 - DNA, 22 bp, Artificial Sequence
  Synthetic Oligonucleotide
caatttctactagtttgtagat

SEQ ID NO: 2899 - DNA, 20 bp, Artificial Sequence
  Synthetic Oligonucleotide
caattcagtgtctttgctgt

SEQ ID NO: 2900 - DNA, 22 bp, Artificial Sequence
  Synthetic Oligonucleotide
gaatttctcctcccgaggagat

SEQ ID NO: 2901 - DNA, 21 bp, Artificial Sequence
  Synthetic Oligonucleotide
caattacggctaagtgtcgtt

SEQ ID NO: 2902 - DNA, 21 bp, Artificial Sequence
  Synthetic Oligonucleotide
caatttctactccccgtagat

SEQ ID NO: 2903 - DNA, 21 bp, Artificial Sequence
  Synthetic Oligonucleotide
caattctgtctaagtggtagt

SEQ ID NO: 2904 - DNA, 21 bp, Artificial Sequence
  Synthetic Oligonucleotide
caattgttattaagtgtaact

SEQ ID NO: 2905 - DNA, 22 bp, Artificial Sequence
  Synthetic Oligonucleotide
gaatttctccagagtaggagat

SEQ ID NO: 2906 - DNA, 20 bp, Artificial Sequence
  Synthetic Oligonucleotide
gaatttctactgcggtagat

SEQ ID NO: 2907 - DNA, 22 bp, Artificial Sequence
  Synthetic Oligonucleotide
gaatttctcccagatgggagat

SEQ ID NO: 2908 - DNA, 20 bp, Artificial Sequence
  Synthetic Oligonucleotide
caattgtgcttcttggcgct

SEQ ID NO: 2909 - DNA, 20 bp, Artificial Sequence
  Synthetic Oligonucleotide
caattactagtcttttggtt

SEQ ID NO: 2910 - DNA, 21 bp, Artificial Sequence
  Synthetic Oligonucleotide
caatttctactcggggtagat

SEQ ID NO: 2911 - DNA, 22 bp, Artificial Sequence
  Synthetic Oligonucleotide
caatttctactgagcagtagat

SEQ ID NO: 2912 - DNA, 21 bp, Artificial Sequence
  Synthetic Oligonucleotide
gaattgcgcttaagtagtgct

SEQ ID NO: 2913 - DNA, 20 bp, Artificial Sequence
  Synthetic Oligonucleotide
caattggcgttcttgcgtct

SEQ ID NO: 2914 - DNA, 22 bp, Artificial Sequence
  Synthetic Oligonucleotide
caatttctacttgccagtagat

SEQ ID NO: 2915 - DNA, 21 bp, Artificial Sequence
  Synthetic Oligonucleotide
caattaccagtaagtttggtt

SEQ ID NO: 2916 - DNA, 21 bp, Artificial Sequence
  Synthetic Oligonucleotide
caatttaggttaagtgcttgt

SEQ ID NO: 2917 - DNA, 21 bp, Artificial Sequence
  Synthetic Oligonucleotide
caattggtgataagtttacct

SEQ ID NO: 2918 - DNA, 22 bp, Artificial Sequence
  Synthetic Oligonucleotide
caatttctactttactgtagat

SEQ ID NO: 2919 - DNA, 20 bp, Artificial Sequence
  Synthetic Oligonucleotide
caattactggtcttttggtt

SEQ ID NO: 2920 - DNA, 21 bp, Artificial Sequence
  Synthetic Oligonucleotide
caatttctcataagttggggt

SEQ ID NO: 2921 - DNA, 22 bp, Artificial Sequence
  Synthetic Oligonucleotide
caatttctactttgccgtagat

SEQ ID NO: 2922 - DNA, 22 bp, Artificial Sequence
  Synthetic Oligonucleotide
caatttctactacggtgtagat

SEQ ID NO: 2923 - DNA, 20 bp, Artificial Sequence
  Synthetic Oligonucleotide
caattaccgatctttcggtt

SEQ ID NO: 2924 - DNA, 21 bp, Artificial Sequence
  Synthetic Oligonucleotide
caattgagcctaagtggctct

SEQ ID NO: 2925 - DNA, 20 bp, Artificial Sequence
  Synthetic Oligonucleotide
caatttggggtcttcttcat

SEQ ID NO: 2926 - DNA, 22 bp, Artificial Sequence
  Synthetic Oligonucleotide
caatttctactgactcgtagat

SEQ ID NO: 2927 - DNA, 20 bp, Artificial Sequence
  Synthetic Oligonucleotide
caattcatgatcttttatgt

SEQ ID NO: 2928 - DNA, 22 bp, Artificial Sequence
  Synthetic Oligonucleotide
gaatttctactgtaacgtagat

SEQ ID NO: 2929 - DNA, 20 bp, Artificial Sequence
  Synthetic Oligonucleotide
gaattgctgttcttacggct

SEQ ID NO: 2930 - DNA, 21 bp, Artificial Sequence
  Synthetic Oligonucleotide
caatttctcccaataggagat

SEQ ID NO: 2931 - DNA, 20 bp, Artificial Sequence
  Synthetic Oligonucleotide
caattctacgtcttcgtagt

SEQ ID NO: 2932 - DNA, 20 bp, Artificial Sequence
  Synthetic Oligonucleotide
caattgttcttcttggaatt

SEQ ID NO: 2933 - DNA, 22 bp, Artificial Sequence
  Synthetic Oligonucleotide
gaatttctcctagtgaggagat

SEQ ID NO: 2934 - DNA, 22 bp, Artificial Sequence
  Synthetic Oligonucleotide
gaatttctactggaatgtagat

SEQ ID NO: 2935 - DNA, 22 bp, Artificial Sequence
  Synthetic Oligonucleotide
caatttctacatatctgtagat

SEQ ID NO: 2936 - DNA, 20 bp, Artificial Sequence
  Synthetic Oligonucleotide
caattgaagttcttacttct

SEQ ID NO: 2937 - DNA, 21 bp, Artificial Sequence
  Synthetic Oligonucleotide
gaatttctactgaacgtagat

SEQ ID NO: 2938 - DNA, 20 bp, Artificial Sequence
  Synthetic Oligonucleotide
caatttctacttccgtagat

SEQ ID NO: 2939 - DNA, 22 bp, Artificial Sequence
  Synthetic Oligonucleotide
caatttctccaggaaaggagat

SEQ ID NO: 2940 - DNA, 20 bp, Artificial Sequence
  Synthetic Oligonucleotide
caattgacgttcttacgtct

SEQ ID NO: 2941 - DNA, 20 bp, Artificial Sequence
  Synthetic Oligonucleotide
aaattcgcgttcttacgcgt

SEQ ID NO: 2942 - DNA, 20 bp, Artificial Sequence
  Synthetic Oligonucleotide
caattcactctcttgggtgt

SEQ ID NO: 2943 - DNA, 22 bp, Artificial Sequence
  Synthetic Oligonucleotide
gaatttctcctactgcggagat

SEQ ID NO: 2944 - DNA, 22 bp, Artificial Sequence
  Synthetic Oligonucleotide
gaatttctacttagctgtagat

SEQ ID NO: 2945 - DNA, 21 bp, Artificial Sequence
  Synthetic Oligonucleotide
caattgggcttaagtggcctt

SEQ ID NO: 2946 - DNA, 21 bp, Artificial Sequence
  Synthetic Oligonucleotide
caatttcgcctaagtggtgat

SEQ ID NO: 2947 - DNA, 22 bp, Artificial Sequence
  Synthetic Oligonucleotide
gaatttctactagtcggtagat

SEQ ID NO: 2948 - DNA, 21 bp, Artificial Sequence
  Synthetic Oligonucleotide
gaattacgtgtaagtcacgtt

SEQ ID NO: 2949 - DNA, 22 bp, Artificial Sequence
  Synthetic Oligonucleotide
caatttctactgaggcgtagat

SEQ ID NO: 2950 - DNA, 21 bp, Artificial Sequence
  Synthetic Oligonucleotide
caattccctgtaagtcggggt

SEQ ID NO: 2951 - DNA, 21 bp, Artificial Sequence
  Synthetic Oligonucleotide
aaatttctccttggcggagat

SEQ ID NO: 2952 - DNA, 21 bp, Artificial Sequence
  Synthetic Oligonucleotide
caatttctccgctccggagat

SEQ ID NO: 2953 - DNA, 20 bp, Artificial Sequence
  Synthetic Oligonucleotide
caattgtttgtcttcaaatt

SEQ ID NO: 2954 - DNA, 21 bp, Artificial Sequence
  Synthetic Oligonucleotide
caattccgagtaagtctcggt

SEQ ID NO: 2955 - DNA, 20 bp, Artificial Sequence
  Synthetic Oligonucleotide
caatttatgttcttgtatat

SEQ ID NO: 2956 - DNA, 20 bp, Artificial Sequence
  Synthetic Oligonucleotide
caattctctctcttgagagt

SEQ ID NO: 2957 - DNA, 21 bp, Artificial Sequence
  Synthetic Oligonucleotide
caattctgggtaagtcttagt

SEQ ID NO: 2958 - DNA, 21 bp, Artificial Sequence
  Synthetic Oligonucleotide
caattaggagtaagtctcctt

SEQ ID NO: 2959 - DNA, 21 bp, Artificial Sequence
  Synthetic Oligonucleotide
gaattgttgataagtttggct

SEQ ID NO: 2960 - DNA, 21 bp, Artificial Sequence
  Synthetic Oligonucleotide
caatttctaccttcagtagat

SEQ ID NO: 2961 - DNA, 20 bp, Artificial Sequence
  Synthetic Oligonucleotide
caattgcggttcttgtcgtt

SEQ ID NO: 2962 - DNA, 21 bp, Artificial Sequence
  Synthetic Oligonucleotide
gaatttctaccttacgtagat

SEQ ID NO: 2963 - DNA, 21 bp, Artificial Sequence
  Synthetic Oligonucleotide
gaatttctcctctgtggagat

SEQ ID NO: 2964 - DNA, 21 bp, Artificial Sequence
  Synthetic Oligonucleotide
caattgggcgtaagttgcttt

SEQ ID NO: 2965 - DNA, 22 bp, Artificial Sequence
  Synthetic Oligonucleotide
caatttctaccttccggtagat

SEQ ID NO: 2966 - DNA, 20 bp, Artificial Sequence
  Synthetic Oligonucleotide
gaatttgtgttcttacgtgt

SEQ ID NO: 2967 - DNA, 21 bp, Artificial Sequence
  Synthetic Oligonucleotide
gaatttctacggactgtagat

SEQ ID NO: 2968 - DNA, 21 bp, Artificial Sequence
  Synthetic Oligonucleotide
caatttctactcactgtagat

SEQ ID NO: 2969 - DNA, 22 bp, Artificial Sequence
  Synthetic Oligonucleotide
caatttctacagaatcgtagat

SEQ ID NO: 2970 - DNA, 20 bp, Artificial Sequence
  Synthetic Oligonucleotide
caattagttctcttggattt

SEQ ID NO: 2971 - DNA, 21 bp, Artificial Sequence
  Synthetic Oligonucleotide
gaattggctgtaagttggtct

SEQ ID NO: 2972 - DNA, 22 bp, Artificial Sequence
  Synthetic Oligonucleotide
caatttctactgcaatgtagat

SEQ ID NO: 2973 - DNA, 21 bp, Artificial Sequence
  Synthetic Oligonucleotide
caatttctaccacacgtagat

SEQ ID NO: 2974 - DNA, 22 bp, Artificial Sequence
  Synthetic Oligonucleotide
caatttctactgaaatgtagat

SEQ ID NO: 2975 - DNA, 21 bp, Artificial Sequence
  Synthetic Oligonucleotide
caatttctcctacctggagat

SEQ ID NO: 2976 - DNA, 21 bp, Artificial Sequence
  Synthetic Oligonucleotide
caattggtcttaagtgggtct

SEQ ID NO: 2977 - DNA, 21 bp, Artificial Sequence
  Synthetic Oligonucleotide
caatttctaccgatggtagat

SEQ ID NO: 2978 - DNA, 22 bp, Artificial Sequence
  Synthetic Oligonucleotide
gaatttctcctatggaggagat

SEQ ID NO: 2979 - DNA, 20 bp, Artificial Sequence
  Synthetic Oligonucleotide
caattatggttcttgtcatt

SEQ ID NO: 2980 - DNA, 20 bp, Artificial Sequence
  Synthetic Oligonucleotide
caattttagctcttgttgat

SEQ ID NO: 2981 - DNA, 22 bp, Artificial Sequence
  Synthetic Oligonucleotide
caatttctactctcgggtagat

SEQ ID NO: 2982 - DNA, 20 bp, Artificial Sequence
  Synthetic Oligonucleotide
caattggtcttcttaggcct

SEQ ID NO: 2983 - DNA, 22 bp, Artificial Sequence
  Synthetic Oligonucleotide
aaatttctacttacgggtagat

SEQ ID NO: 2984 - DNA, 20 bp, Artificial Sequence
  Synthetic Oligonucleotide
gaattgctgctcttgcagtt

SEQ ID NO: 2985 - DNA, 21 bp, Artificial Sequence
  Synthetic Oligonucleotide
caattgccgctaagtgcggct

SEQ ID NO: 2986 - DNA, 21 bp, Artificial Sequence
  Synthetic Oligonucleotide
caattggttttaagtgggttt

SEQ ID NO: 2987 - DNA, 20 bp, Artificial Sequence
  Synthetic Oligonucleotide
caattgcggctcttgttgct

SEQ ID NO: 2988 - DNA, 21 bp, Artificial Sequence
  Synthetic Oligonucleotide
caatttctgataagttcagat

SEQ ID NO: 2989 - DNA, 22 bp, Artificial Sequence
  Synthetic Oligonucleotide
aaatttctactaccatgtagat

SEQ ID NO: 2990 - DNA, 22 bp, Artificial Sequence
  Synthetic Oligonucleotide
caatttctacaccggtgtagat

SEQ ID NO: 2991 - DNA, 22 bp, Artificial Sequence
  Synthetic Oligonucleotide
caatttctactcaatagtagat

SEQ ID NO: 2992 - DNA, 21 bp, Artificial Sequence
  Synthetic Oligonucleotide
caatttcagttaagtgttgat

SEQ ID NO: 2993 - DNA, 20 bp, Artificial Sequence
  Synthetic Oligonucleotide
caattaatgttcttatgttt

SEQ ID NO: 2994 - DNA, 20 bp, Artificial Sequence
  Synthetic Oligonucleotide
caattggttttcttaagcct

SEQ ID NO: 2995 - DNA, 20 bp, Artificial Sequence
  Synthetic Oligonucleotide
caattgactttcttaagtct

SEQ ID NO: 2996 - DNA, 21 bp, Artificial Sequence
  Synthetic Oligonucleotide
caattagtggtaagtccactt

SEQ ID NO: 2997 - DNA, 20 bp, Artificial Sequence
  Synthetic Oligonucleotide
caattccctctcttgggggt

SEQ ID NO: 2998 - DNA, 22 bp, Artificial Sequence
  Synthetic Oligonucleotide
caatttctacttatgagtagat

SEQ ID NO: 2999 - DNA, 21 bp, Artificial Sequence
  Synthetic Oligonucleotide
gaatttctaccacttgtagat

SEQ ID NO: 3000 - DNA, 22 bp, Artificial Sequence
  Synthetic Oligonucleotide
caatttctactcacgcgtagat

SEQ ID NO: 3001 - DNA, 21 bp, Artificial Sequence
  Synthetic Oligonucleotide
caattctaagtaagtcttggt

SEQ ID NO: 3002 - DNA, 21 bp, Artificial Sequence
  Synthetic Oligonucleotide
caatttctacctcccgtagat

SEQ ID NO: 3003 - DNA, 21 bp, Artificial Sequence
  Synthetic Oligonucleotide
caattcgggttaagtacttgt

SEQ ID NO: 3004 - DNA, 22 bp, Artificial Sequence
  Synthetic Oligonucleotide
gaatttctccatcccgggagat

SEQ ID NO: 3005 - DNA, 22 bp, Artificial Sequence
  Synthetic Oligonucleotide
caatttctactacatggtagat

SEQ ID NO: 3006 - DNA, 21 bp, Artificial Sequence
  Synthetic Oligonucleotide
caattgcgagtaagtttcgtt

SEQ ID NO: 3007 - DNA, 20 bp, Artificial Sequence
  Synthetic Oligonucleotide
caattggttttcttgagttt

SEQ ID NO: 3008 - DNA, 21 bp, Artificial Sequence
  Synthetic Oligonucleotide
caatttctactcgatgtagat

SEQ ID NO: 3009 - DNA, 22 bp, Artificial Sequence
  Synthetic Oligonucleotide
caatttctactaggccgtagat

SEQ ID NO: 3010 - DNA, 22 bp, Artificial Sequence
  Synthetic Oligonucleotide
caatttctacttacatgtagat

SEQ ID NO: 3011 - DNA, 21 bp, Artificial Sequence
  Synthetic Oligonucleotide
gaatttctactgcgtgtagat

SEQ ID NO: 3012 - DNA, 22 bp, Artificial Sequence
  Synthetic Oligonucleotide
caatttctcctacggcggagat

SEQ ID NO: 3013 - DNA, 21 bp, Artificial Sequence
  Synthetic Oligonucleotide
caatttgccttaagtaggcat

SEQ ID NO: 3014 - DNA, 22 bp, Artificial Sequence
  Synthetic Oligonucleotide
caatttctacttcctagtagat

SEQ ID NO: 3015 - DNA, 22 bp, Artificial Sequence
  Synthetic Oligonucleotide
aaatttctacacgtacgtagat

SEQ ID NO: 3016 - DNA, 20 bp, Artificial Sequence
  Synthetic Oligonucleotide
caattgctcttcttagagct

SEQ ID NO: 3017 - DNA, 21 bp, Artificial Sequence
  Synthetic Oligonucleotide
aaatttctacgcaccgtagat

SEQ ID NO: 3018 - DNA, 20 bp, Artificial Sequence
  Synthetic Oligonucleotide
caattatttgtcttcggatt

SEQ ID NO: 3019 - DNA, 21 bp, Artificial Sequence
  Synthetic Oligonucleotide
gaattggtcgtaagtcgattt

SEQ ID NO: 3020 - DNA, 21 bp, Artificial Sequence
  Synthetic Oligonucleotide
caatttctactgccggtagat

SEQ ID NO: 3021 - DNA, 22 bp, Artificial Sequence
  Synthetic Oligonucleotide
gaatttctactgcttggtagat

SEQ ID NO: 3022 - DNA, 22 bp, Artificial Sequence
  Synthetic Oligonucleotide
gaatttctacgatcccgtagat

SEQ ID NO: 3023 - DNA, 22 bp, Artificial Sequence
  Synthetic Oligonucleotide
caatttctactgtcaggtagat

SEQ ID NO: 3024 - DNA, 22 bp, Artificial Sequence
  Synthetic Oligonucleotide
caatttctactactgcgtagat

SEQ ID NO: 3025 - DNA, 20 bp, Artificial Sequence
  Synthetic Oligonucleotide
gaattcgcgttcttacgcgt

SEQ ID NO: 3026 - DNA, 20 bp, Artificial Sequence
  Synthetic Oligonucleotide
caatttgacgtcttcgttgt

SEQ ID NO: 3027 - DNA, 21 bp, Artificial Sequence
  Synthetic Oligonucleotide
caattttgtttaagtgacgat

SEQ ID NO: 3028 - DNA, 21 bp, Artificial Sequence
  Synthetic Oligonucleotide
caattcatattaagtgtgtgt

SEQ ID NO: 3029 - DNA, 21 bp, Artificial Sequence
  Synthetic Oligonucleotide
caatttctactatatgtagat

SEQ ID NO: 3030 - DNA, 21 bp, Artificial Sequence
  Synthetic Oligonucleotide
gaatttctacttgcagtagat

SEQ ID NO: 3031 - DNA, 20 bp, Artificial Sequence
  Synthetic Oligonucleotide
caattatacgtctttgtgtt

SEQ ID NO: 3032 - DNA, 21 bp, Artificial Sequence
  Synthetic Oligonucleotide
caattagttgtaagttgactt

SEQ ID NO: 3033 - DNA, 20 bp, Artificial Sequence
  Synthetic Oligonucleotide
gaattgtggctcttgccgtt

SEQ ID NO: 3034 - DNA, 22 bp, Artificial Sequence
  Synthetic Oligonucleotide
aaatttctactaacccgtagat

SEQ ID NO: 3035 - DNA, 22 bp, Artificial Sequence
  Synthetic Oligonucleotide
aaatttctacttcgaagtagat

SEQ ID NO: 3036 - DNA, 21 bp, Artificial Sequence
  Synthetic Oligonucleotide
gaatttctactaaccgtagat

SEQ ID NO: 3037 - DNA, 22 bp, Artificial Sequence
  Synthetic Oligonucleotide
gaatttctacttaggagtagat

SEQ ID NO: 3038 - DNA, 20 bp, Artificial Sequence
  Synthetic Oligonucleotide
aaattcgcgttcttacgtgt

SEQ ID NO: 3039 - DNA, 21 bp, Artificial Sequence
  Synthetic Oligonucleotide
gaatttctacccttagtagat

SEQ ID NO: 3040 - DNA, 20 bp, Artificial Sequence
  Synthetic Oligonucleotide
caattgtctttcttgagatt

SEQ ID NO: 3041 - DNA, 22 bp, Artificial Sequence
  Synthetic Oligonucleotide
caatttctacgagactgtagat

SEQ ID NO: 3042 - DNA, 20 bp, Artificial Sequence
  Synthetic Oligonucleotide
caattatccttcttggggtt

SEQ ID NO: 3043 - DNA, 21 bp, Artificial Sequence
  Synthetic Oligonucleotide
caatttctactcagggtagat

SEQ ID NO: 3044 - DNA, 21 bp, Artificial Sequence
  Synthetic Oligonucleotide
gaatttctcctgggtggagat

SEQ ID NO: 3045 - DNA, 22 bp, Artificial Sequence
  Synthetic Oligonucleotide
caatttctactgcttcgtagat

SEQ ID NO: 3046 - DNA, 21 bp, Artificial Sequence
  Synthetic Oligonucleotide
gaatttggggtaagttcccgt

SEQ ID NO: 3047 - DNA, 21 bp, Artificial Sequence
  Synthetic Oligonucleotide
caattcctattaagtgtgggt

SEQ ID NO: 3048 - DNA, 20 bp, Artificial Sequence
  Synthetic Oligonucleotide
caatttaggctcttgtctat

SEQ ID NO: 3049 - DNA, 20 bp, Artificial Sequence
  Synthetic Oligonucleotide
caattaggcatctttgtttt

SEQ ID NO: 3050 - DNA, 21 bp, Artificial Sequence
  Synthetic Oligonucleotide
caattcggactaagtgtccgt

SEQ ID NO: 3051 - DNA, 22 bp, Artificial Sequence
  Synthetic Oligonucleotide
aaatttctccacaatgggagat

SEQ ID NO: 3052 - DNA, 20 bp, Artificial Sequence
  Synthetic Oligonucleotide
caatttcccgtcttcggggt

SEQ ID NO: 3053 - DNA, 21 bp, Artificial Sequence
  Synthetic Oligonucleotide
caatttctacaatatgtagat

SEQ ID NO: 3054 - DNA, 21 bp, Artificial Sequence
  Synthetic Oligonucleotide
caatttctactggaagtagat

SEQ ID NO: 3055 - DNA, 22 bp, Artificial Sequence
  Synthetic Oligonucleotide
caatttctacttactagtagat

SEQ ID NO: 3056 - DNA, 21 bp, Artificial Sequence
  Synthetic Oligonucleotide
caattagctttaagtgagttt

SEQ ID NO: 3057 - DNA, 20 bp, Artificial Sequence
  Synthetic Oligonucleotide
gaattcgtcttcttgggcgt

SEQ ID NO: 3058 - DNA, 21 bp, Artificial Sequence
  Synthetic Oligonucleotide
caattacaagtaagtcttgtt

SEQ ID NO: 3059 - DNA, 20 bp, Artificial Sequence
  Synthetic Oligonucleotide
caatttttggtctttcgggt

SEQ ID NO: 3060 - DNA, 21 bp, Artificial Sequence
  Synthetic Oligonucleotide
gaatttctacaccctgtagat

SEQ ID NO: 3061 - DNA, 20 bp, Artificial Sequence
  Synthetic Oligonucleotide
caatttctactgcggtagat

SEQ ID NO: 3062 - DNA, 21 bp, Artificial Sequence
  Synthetic Oligonucleotide
caattgtgactaagtgttatt

SEQ ID NO: 3063 - DNA, 21 bp, Artificial Sequence
  Synthetic Oligonucleotide
gaattgcctgtaagtcaggtt

SEQ ID NO: 3064 - DNA, 22 bp, Artificial Sequence
  Synthetic Oligonucleotide
caatttctacactcatgtagat

SEQ ID NO: 3065 - DNA, 22 bp, Artificial Sequence
  Synthetic Oligonucleotide
caatttctactgtcttgtagat

SEQ ID NO: 3066 - DNA, 20 bp, Artificial Sequence
  Synthetic Oligonucleotide
caattcactctcttgagtgt

SEQ ID NO: 3067 - DNA, 20 bp, Artificial Sequence
  Synthetic Oligonucleotide
gaattggtgttcttgcgcct

SEQ ID NO: 3068 - DNA, 22 bp, Artificial Sequence
  Synthetic Oligonucleotide
caatttctactgatgtgtagat

SEQ ID NO: 3069 - DNA, 21 bp, Artificial Sequence
  Synthetic Oligonucleotide
gaatttctactattagtagat

SEQ ID NO: 3070 - DNA, 21 bp, Artificial Sequence
  Synthetic Oligonucleotide
caatttaggttaagtgtctgt

SEQ ID NO: 3071 - DNA, 21 bp, Artificial Sequence
  Synthetic Oligonucleotide
gaatttctacgacttgtagat

SEQ ID NO: 3072 - DNA, 21 bp, Artificial Sequence
  Synthetic Oligonucleotide
caattacttgtaagttgagtt

SEQ ID NO: 3073 - DNA, 21 bp, Artificial Sequence
  Synthetic Oligonucleotide
caatttctactcccagtagat

SEQ ID NO: 3074 - DNA, 20 bp, Artificial Sequence
  Synthetic Oligonucleotide
gaattcactgtcttcggtgt

SEQ ID NO: 3075 - DNA, 21 bp, Artificial Sequence
  Synthetic Oligonucleotide
gaatttctcctaactggagat

SEQ ID NO: 3076 - DNA, 21 bp, Artificial Sequence
  Synthetic Oligonucleotide
aaattctgtgtaagtcatggt

SEQ ID NO: 3077 - DNA, 22 bp, Artificial Sequence
  Synthetic Oligonucleotide
caatttctactggcgcgtagat

SEQ ID NO: 3078 - DNA, 20 bp, Artificial Sequence
  Synthetic Oligonucleotide
caattagtcgtcttcgattt

SEQ ID NO: 3079 - DNA, 22 bp, Artificial Sequence
  Synthetic Oligonucleotide
gaatttctactatgtggtagat

SEQ ID NO: 3080 - DNA, 20 bp, Artificial Sequence
  Synthetic Oligonucleotide
gaatttctactgctgtagat

SEQ ID NO: 3081 - DNA, 22 bp, Artificial Sequence
  Synthetic Oligonucleotide
caatttctacttttacgtagat

SEQ ID NO: 3082 - DNA, 20 bp, Artificial Sequence
  Synthetic Oligonucleotide
caatttatggtcttccatat

SEQ ID NO: 3083 - DNA, 21 bp, Artificial Sequence
  Synthetic Oligonucleotide
caatttctactagacgtagat

SEQ ID NO: 3084 - DNA, 21 bp, Artificial Sequence
  Synthetic Oligonucleotide
caattttttctaagtgagggt

SEQ ID NO: 3085 - DNA, 22 bp, Artificial Sequence
  Synthetic Oligonucleotide
gaatttctccgcaatgggagat

SEQ ID NO: 3086 - DNA, 21 bp, Artificial Sequence
  Synthetic Oligonucleotide
caatttgtgctaagtgtgtgt

SEQ ID NO: 3087 - DNA, 20 bp, Artificial Sequence
  Synthetic Oligonucleotide
caattcgctctcttgagtgt

SEQ ID NO: 3088 - DNA, 20 bp, Artificial Sequence
  Synthetic Oligonucleotide
  misc_feature (17)..(17): n is a, t, c, or g
caattyykkytcttgwnggt

SEQ ID NO: 3089 - DNA, 21 bp, Artificial Sequence
  Synthetic Oligonucleotide
caattryrygtaagtygbgyt

SEQ ID NO: 3090 - DNA, 21 bp, Artificial Sequence
  Synthetic Oligonucleotide
caattgkykytaagtgygkyt

SEQ ID NO: 3091 - DNA, 20 bp, Artificial Sequence
  Synthetic Oligonucleotide
caattrykgbtcttbydgyt

SEQ ID NO: 3092 - DNA, 21 bp, Artificial Sequence
  Synthetic Oligonucleotide
  misc_feature (16)..(16): N is A, T, G, or C
  misc_feature (18)..(18): N is A, T, G, or C
vaattcgkybtaagtngnygt

SEQ ID NO: 3093 - DNA, 20 bp, Artificial Sequence
  Synthetic Oligonucleotide
caattdcyyktcttdgrght

SEQ ID NO: 3094 - DNA, 20 bp, Artificial Sequence
  Synthetic Oligonucleotide
caattkgkgktcttkybyyt

SEQ ID NO: 3095 - DNA, 21 bp, Artificial Sequence
  Synthetic Oligonucleotide
  misc_feature (18)..(18): N is A, T, G, or C
caattrgkggtaagtccnyyt

SEQ ID NO: 3096 - DNA, 21 bp, Artificial Sequence
  Synthetic Oligonucleotide
caattycbggtaagtyysggt

SEQ ID NO: 3097 - DNA, 20 bp, Artificial Sequence
  Synthetic Oligonucleotide
  misc_feature (8)..(8): N is A, T, G, or C
  misc_feature (17)..(17): N is A, T, G, or C
gaattgtnygtcttcgngct

SEQ ID NO: 3098 - DNA, 20 bp, Artificial Sequence
  Synthetic Oligonucleotide
caattbgygytcttrygydt

SEQ ID NO: 3099 - DNA, 20 bp, Artificial Sequence
  Synthetic Oligonucleotide
caattgghybtcttbgdyyt

SEQ ID NO: 3100 - DNA, 21 bp, Artificial Sequence
  Synthetic Oligonucleotide
  misc_feature (17)..(17): N is A, T, G, or C
caattgygbytaagtgnygyt

SEQ ID NO: 3101 - DNA, 20 bp, Artificial Sequence
  Synthetic Oligonucleotide
maattgygyctcttgrygyt

SEQ ID NO: 3102 - DNA, 20 bp, Artificial Sequence
  Synthetic Oligonucleotide
  misc_feature (8)..(8): N is A, T, G, or C
caattygnystcttbgkygt

SEQ ID NO: 3103 - DNA, 21 bp, Artificial Sequence
  Synthetic Oligonucleotide
caattrgrbytaagtgdycyt

SEQ ID NO: 3104 - DNA, 20 bp, Artificial Sequence
  Synthetic Oligonucleotide
caattyygygtcttyryggt

SEQ ID NO: 3105 - DNA, 21 bp, Artificial Sequence
  Synthetic Oligonucleotide
caattygygbtaagtrygygt

SEQ ID NO: 3106 - DNA, 20 bp, Artificial Sequence
  Synthetic Oligonucleotide
caattrygygtcttygygyt

SEQ ID NO: 3107 - DNA, 21 bp, Artificial Sequence
  Synthetic Oligonucleotide
caattyykrytaagtgyyggt

SEQ ID NO: 3108 - DNA, 21 bp, Artificial Sequence
  Synthetic Oligonucleotide
raatttctactargygtagat

SEQ ID NO: 3109 - DNA, 22 bp, Artificial Sequence
  Synthetic Oligonucleotide
raatttctactrgygygtagat

SEQ ID NO: 3110 - DNA, 22 bp, Artificial Sequence
  Synthetic Oligonucleotide
gaatttctactryygrgtagat

SEQ ID NO: 3111 - DNA, 22 bp, Artificial Sequence
  Synthetic Oligonucleotide
gaatttctactdyyyygtagat

SEQ ID NO: 3112 - DNA, 21 bp, Artificial Sequence
  Synthetic Oligonucleotide
raatttctactrcwwgtagat

SEQ ID NO: 3113 - DNA, 22 bp, Artificial Sequence
  Synthetic Oligonucleotide
raatttctactryrrygtagat

SEQ ID NO: 3114 - DNA, 22 bp, Artificial Sequence
  Synthetic Oligonucleotide
gaatttctactyydrygtagat

SEQ ID NO: 3115 - DNA, 22 bp, Artificial Sequence
  Synthetic Oligonucleotide
  misc_feature (14)..(14): N is A, T, G, or C
gaatttctactrrncdgtagat

SEQ ID NO: 3116 - DNA, 20 bp, Artificial Sequence
  Synthetic Oligonucleotide
gaatttctactbbbgtagat

SEQ ID NO: 3117 - DNA, 21 bp, Artificial Sequence
  Synthetic Oligonucleotide
gaatttctactrgyhgtagat

SEQ ID NO: 3118 - DNA, 22 bp, Artificial Sequence
  Synthetic Oligonucleotide
gaatttctactyrhhcgtagat

SEQ ID NO: 3119 - DNA, 22 bp, Artificial Sequence
  Synthetic Oligonucleotide
gaatttctactcdyyrgtagat

SEQ ID NO: 3120 - DNA, 22 bp, Artificial Sequence
  Synthetic Oligonucleotide
  misc_feature (13)..(13): N is A, T, G, or C
raatttctcctanygyggagat

SEQ ID NO: 3121 - DNA, 21 bp, Artificial Sequence
  Synthetic Oligonucleotide
caatttctactrrgwgtagat

SEQ ID NO: 3122 - DNA, 22 bp, Artificial Sequence
  Synthetic Oligonucleotide
gaatttctactdygyggtagat

SEQ ID NO: 3123 - DNA, 21 bp, Artificial Sequence
  Synthetic Oligonucleotide
raatttctcctahghggagat

SEQ ID NO: 3124 - DNA, 22 bp, Artificial Sequence
  Synthetic Oligonucleotide
caatttctacthyyyygtagat

SEQ ID NO: 3125 - DNA, 22 bp, Artificial Sequence
  Synthetic Oligonucleotide
caatttctactwcyrhgtagat

SEQ ID NO: 3126 - DNA, 22 bp, Artificial Sequence
  Synthetic Oligonucleotide
caatttctactycryygtagat

SEQ ID NO: 3127 - DNA, 22 bp, Artificial Sequence
  Synthetic Oligonucleotide
  misc_feature (13)..(13): N is A, T, G, or C
  misc_feature (16)..(16): N is A, T, G, or C
caatttctcctanbgnggagat

SEQ ID NO: 3128 - DNA, 22 bp, Artificial Sequence
  Synthetic Oligonucleotide
caatttctactrdryygtagat

SEQ ID NO: 3129 - DNA, 21 bp, Artificial Sequence
  Synthetic Oligonucleotide
caatttctactyyrygtagat

SEQ ID NO: 3130 - DNA, 21 bp, Artificial Sequence
  Synthetic Oligonucleotide
caatttctactryrrgtagat

SEQ ID NO: 3131 - DNA, 22 bp, Artificial Sequence
  Synthetic Oligonucleotide
caatttctactrryrygtagat

SEQ ID NO: 3132 - DNA, 21 bp, Artificial Sequence
  Synthetic Oligonucleotide
caatttctcctayywggagat

SEQ ID NO: 3133 - DNA, 21 bp, Artificial Sequence
  Synthetic Oligonucleotide
caatttctactryyygtagat

SEQ ID NO: 3134 - DNA, 22 bp, Artificial Sequence
  Synthetic Oligonucleotide
caatttctactmragrgtagat

SEQ ID NO: 3135 - DNA, 22 bp, Artificial Sequence
  Synthetic Oligonucleotide
raatttctcctadrkyggagat

SEQ ID NO: 3136 - DNA, 22 bp, Artificial Sequence
  Synthetic Oligonucleotide
caatttctactydggygtagat

SEQ ID NO: 3137 - DNA, 21 bp, Artificial Sequence
  Synthetic Oligonucleotide
  misc_feature (13)..(13): N is A, T, G, or C
caatttctcctangwggagat

SEQ ID NO: 3138 - DNA, 22 bp, Artificial Sequence
  Synthetic Oligonucleotide
caatttctactrhyyrgtagat

SEQ ID NO: 3139 - DNA, 22 bp, Artificial Sequence
  Synthetic Oligonucleotide
caatttctactwcrdrgtagat

SEQ ID NO: 3140 - DNA, 22 bp, Artificial Sequence
  Synthetic Oligonucleotide
caatttctactgyrgygtagat

SEQ ID NO: 3141 - DNA, 22 bp, Artificial Sequence
  Synthetic Oligonucleotide
caatttctactrryrggtagat

SEQ ID NO: 3142 - DNA, 21 bp, Artificial Sequence
  Synthetic Oligonucleotide
raatttctactmyrygtagat

SEQ ID NO: 3143 - DNA, 22 bp, Artificial Sequence
  Synthetic Oligonucleotide
gaatttctcctayvyhggagat

SEQ ID NO: 3144 - DNA, 22 bp, Artificial Sequence
  Synthetic Oligonucleotide
caatttctactyrgyrgtagat

SEQ ID NO: 3145 - DNA, 20 bp, Artificial Sequence
  Synthetic Oligonucleotide
caatttctactrhdgtagat

SEQ ID NO: 3146 - DNA, 21 bp, Artificial Sequence
  Synthetic Oligonucleotide
caatttctactyydggtagat

SEQ ID NO: 3147 - DNA, 21 bp, Artificial Sequence
  Synthetic Oligonucleotide
  misc_feature (8)..(8): N is A, T, G, or C
vaattrknkrtaagtymssyt

SEQ ID NO: 3148 - DNA, 22 bp, Artificial Sequence
  Synthetic Oligonucleotide
caatttctactccymrgtagat

SEQ ID NO: 3149 - DNA, 22 bp, Artificial Sequence
  Synthetic Oligonucleotide
caatttctactcryhcgtagat

SEQ ID NO: 3150 - DNA, 22 bp, Artificial Sequence
  Synthetic Oligonucleotide
caatttctcctabbyyggagat

SEQ ID NO: 3151 - DNA, 22 bp, Artificial Sequence
  Synthetic Oligonucleotide
caatttctactrrcyygtagat

SEQ ID NO: 3152 - DNA, 21 bp, Artificial Sequence
  Synthetic Oligonucleotide
  misc_feature (15)..(15): n is a, t, g, or c
gaatttctacyyyyngtagat

SEQ ID NO: 3153 - DNA, 21 bp, Artificial Sequence
  Synthetic Oligonucleotide
  misc_feature (15)..(15): N is A, T, G, or C
caatttctacthryngtagat

SEQ ID NO: 3154 - DNA, 20 bp, Artificial Sequence
  Synthetic Oligonucleotide
caatttcymhtcttgkrgrt

SEQ ID NO: 3155 - DNA, 22 bp, Artificial Sequence
  Synthetic Oligonucleotide
caatttctactygywrgtagat

SEQ ID NO: 3156 - DNA, 20 bp, Artificial Sequence
  Synthetic Oligonucleotide
  misc_feature (17)..(17): N is A, T, G, or C
saattgkkyrtcttydnvyt

SEQ ID NO: 3157 - DNA, 22 bp, Artificial Sequence
  Synthetic Oligonucleotide
gaatttctactrymyygtagat

SEQ ID NO: 3158 - DNA, 20 bp, Artificial Sequence
  Synthetic Oligonucleotide
saatttctactywhgtagat

SEQ ID NO: 3159 - DNA, 21 bp, Artificial Sequence
  Synthetic Oligonucleotide
  misc_feature (17)..(17): N is A, T, G, or C
caattyrkkbtaagtkndygt

SEQ ID NO: 3160 - DNA, 20 bp, Artificial Sequence
  Synthetic Oligonucleotide
  misc_feature (14)..(14): N is A, T, G, or C
saatttctactrhngtagat

SEQ ID NO: 3161 - DNA, 21 bp, Artificial Sequence
  Synthetic Oligonucleotide
  misc_feature (11)..(11): N is A, T, G, or C
raatttctccnhvbvggagat

SEQ ID NO: 3162 - DNA, 20 bp, Artificial Sequence
  Synthetic Oligonucleotide
saatttctcctmhhggagat

SEQ ID NO: 3163 - DNA, 21 bp, Artificial Sequence
  Synthetic Oligonucleotide
gaatttctactdvvvgtagat

SEQ ID NO: 3164 - DNA, 22 bp, Artificial Sequence
  Synthetic Oligonucleotide
gaatttctactryrgygtagat

SEQ ID NO: 3165 - DNA, 20 bp, Artificial Sequence
  Synthetic Oligonucleotide
maattgkyyrtcttyggsyt

SEQ ID NO: 3166 - DNA, 22 bp, Artificial Sequence
  Synthetic Oligonucleotide
raatttctactydcrygtagat

SEQ ID NO: 3167 - DNA, 21 bp, Artificial Sequence
  Synthetic Oligonucleotide
caatttctachryyygtagat

SEQ ID NO: 3168 - DNA, 22 bp, Artificial Sequence
  Synthetic Oligonucleotide
gaatttctactrrwwhgtagat

SEQ ID NO: 3169 - DNA, 22 bp, Artificial Sequence
  Synthetic Oligonucleotide
  misc_feature (13)..(13): N is A, T, G, or C
gaatttctactcnhycgtagat

SEQ ID NO: 3170 - DNA, 21 bp, Artificial Sequence
  Synthetic Oligonucleotide
  misc_feature (11)..(11): N is A, T, G, or C
caatttctccnhmrkggagat

SEQ ID NO: 3171 - DNA, 22 bp, Artificial Sequence
  Synthetic Oligonucleotide
  misc_feature (16)..(16): N is A, T, G, or C
gaatttctccvydscnggagat

SEQ ID NO: 3172 - DNA, 21 bp, Artificial Sequence
  Synthetic Oligonucleotide
caatttctactrrrwgtagat

SEQ ID NO: 3173 - DNA, 20 bp, Artificial Sequence
  Synthetic Oligonucleotide
saattkbgyrtcttygydst

SEQ ID NO: 3174 - DNA, 21 bp, Artificial Sequence
  Synthetic Oligonucleotide
maatttctacwcvrygtagat

SEQ ID NO: 3175 - DNA, 22 bp, Artificial Sequence
  Synthetic Oligonucleotide
  misc_feature (13)..(13): N is A, T, G, or C
caatttctactbnyrygtagat

SEQ ID NO: 3176 - DNA, 22 bp, Artificial Sequence
  Synthetic Oligonucleotide
  misc_feature (13)..(13): N is A, T, G, or C
caatttctactynyyygtagat

SEQ ID NO: 3177 - DNA, 21 bp, Artificial Sequence
  Synthetic Oligonucleotide
  misc_feature (16)..(16): N is A, T, G, or C
caattghkkktaagtnbbdyt

SEQ ID NO: 3178 - DNA, 22 bp, Artificial Sequence
  Synthetic Oligonucleotide
  misc_feature (15)..(16): N is A, T, G, or C
caatttctccddwrnnggagat

SEQ ID NO: 3179 - DNA, 20 bp, Artificial Sequence
  Synthetic Oligonucleotide
caattrrygrtcttyyrybt

SEQ ID NO: 3180 - DNA, 22 bp, Artificial Sequence
  Synthetic Oligonucleotide
caatttctactdhryygtagat

SEQ ID NO: 3181 - DNA, 20 bp, Artificial Sequence
  Synthetic Oligonucleotide
  misc_feature (9)..(9): N is A, T, G, or C
caattdgknytcttgdvykt

SEQ ID NO: 3182 - DNA, 20 bp, Artificial Sequence
  Synthetic Oligonucleotide
  misc_feature (15)..(15): N is A, T, G, or C
caattyygrrtcttnyyrgt

SEQ ID NO: 3183 - DNA, 22 bp, Artificial Sequence
  Synthetic Oligonucleotide
gaatttctmckyygwhgkagat

SEQ ID NO: 3184 - DNA, 22 bp, Artificial Sequence
  Synthetic Oligonucleotide
caatttctcccmsrmyggagat

SEQ ID NO: 3185 - DNA, 21 bp, Artificial Sequence
  Synthetic Oligonucleotide
raatttctactrrgygtagat

SEQ ID NO: 3186 - DNA, 21 bp, Artificial Sequence
  Synthetic Oligonucleotide
raatttctactdyrygtagat

SEQ ID NO: 3187 - DNA, 22 bp, Artificial Sequence
  Synthetic Oligonucleotide
gaatttctacthcrgygtagat

SEQ ID NO: 3188 - DNA, 21 bp, Artificial Sequence
  Synthetic Oligonucleotide
caatttctactrgcdgtagat

SEQ ID NO: 3189 - DNA, 22 bp, Artificial Sequence
  Synthetic Oligonucleotide
gaatttctactrkdyygtagat

SEQ ID NO: 3190 - DNA, 22 bp, Artificial Sequence
  Synthetic Oligonucleotide
gaatttctactrhygmgtagat

SEQ ID NO: 3191 - DNA, 22 bp, Artificial Sequence
  Synthetic Oligonucleotide
gaatttctacthrykrgtagat

SEQ ID NO: 3192 - DNA, 21 bp, Artificial Sequence
  Synthetic Oligonucleotide
caatttctactrrgwgtagat

SEQ ID NO: 3193 - DNA, 21 bp, Artificial Sequence
  Synthetic Oligonucleotide
raatttctactdyyygtagat

SEQ ID NO: 3194 - DNA, 22 bp, Artificial Sequence
  Synthetic Oligonucleotide
raatttctacthrrgygtagat

SEQ ID NO: 3195 - DNA, 22 bp, Artificial Sequence
  Synthetic Oligonucleotide
  misc_feature (14)..(14): N is A, T, G, or C
raatttctactycnrrgtagat

SEQ ID NO: 3196 - DNA, 22 bp, Artificial Sequence
  Synthetic Oligonucleotide
gaatttctactycyyygtagat

SEQ ID NO: 3197 - DNA, 21 bp, Artificial Sequence
  Synthetic Oligonucleotide
caatttctactrydygtagat

SEQ ID NO: 3198 - DNA, 20 bp, Artificial Sequence
  Synthetic Oligonucleotide
gaatttctactvbbgtagat

SEQ ID NO: 3199 - DNA, 22 bp, Artificial Sequence
  Synthetic Oligonucleotide
caatttctactwrwrwgtagat

SEQ ID NO: 3200 - DNA, 22 bp, Artificial Sequence
  Synthetic Oligonucleotide
gaatttctactrhdyrgtagat

SEQ ID NO: 3201 - DNA, 22 bp, Artificial Sequence
  Synthetic Oligonucleotide
caatttctactarygygtagat

SEQ ID NO: 3202 - DNA, 21 bp, Artificial Sequence
  Synthetic Oligonucleotide
gaatttctactydyrgtagat

SEQ ID NO: 3203 - DNA, 21 bp, Artificial Sequence
  Synthetic Oligonucleotide
gaatttctcctaybyggagat

SEQ ID NO: 3204 - DNA, 21 bp, Artificial Sequence
  Synthetic Oligonucleotide
caatttctacthyhggtagat

SEQ ID NO: 3205 - DNA, 22 bp, Artificial Sequence
  Synthetic Oligonucleotide
gaatttctcctayygyggagat

SEQ ID NO: 3206 - DNA, 21 bp, Artificial Sequence
  Synthetic Oligonucleotide
raatttctcctargtggagat

SEQ ID NO: 3207 - DNA, 22 bp, Artificial Sequence
  Synthetic Oligonucleotide
caatttctactwwygrgtagat

SEQ ID NO: 3208 - DNA, 22 bp, Artificial Sequence
  Synthetic Oligonucleotide
caatttctactrydrygtagat

SEQ ID NO: 3209 - DNA, 22 bp, Artificial Sequence
  Synthetic Oligonucleotide
caatttctactdryyygtagat

SEQ ID NO: 3210 - DNA, 21 bp, Artificial Sequence
  Synthetic Oligonucleotide
caatttctactydyygtagat

SEQ ID NO: 3211 - DNA, 20 bp, Artificial Sequence
  Synthetic Oligonucleotide
caatttctactrybgtagat

SEQ ID NO: 3212 - DNA, 22 bp, Artificial Sequence
  Synthetic Oligonucleotide
caatttctactrdryhgtagat

SEQ ID NO: 3213 - DNA, 22 bp, Artificial Sequence
  Synthetic Oligonucleotide
caatttctactwyrrrgtagat

SEQ ID NO: 3214 - DNA, 21 bp, Artificial Sequence
  Synthetic Oligonucleotide
caatttctcctahshggagat

SEQ ID NO: 3215 - DNA, 22 bp, Artificial Sequence
  Synthetic Oligonucleotide
caatttctcctaykgwggagat

SEQ ID NO: 3216 - DNA, 22 bp, Artificial Sequence
  Synthetic Oligonucleotide
caatttctactwyyyrgtagat

SEQ ID NO: 3217 - DNA, 22 bp, Artificial Sequence
  Synthetic Oligonucleotide
caatttctactyygyygtagat

SEQ ID NO: 3218 - DNA, 22 bp, Artificial Sequence
  Synthetic Oligonucleotide
caatttctactyyywygtagat

SEQ ID NO: 3219 - DNA, 21 bp, Artificial Sequence
  Synthetic Oligonucleotide
maattggygctaagtgyrcct

SEQ ID NO: 3220 - DNA, 21 bp, Artificial Sequence
  Synthetic Oligonucleotide
  misc_feature (6)..(6): N is A, T, G, or C
  misc_feature (9)..(9): N is A, T, G, or C
caattncyngtaagtckrgkt

SEQ ID NO: 3221 - DNA, 22 bp, Artificial Sequence
  Synthetic Oligonucleotide
  misc_feature (14)..(14): N is A, T, G, or C
raatttctccwrvnbrggagat

SEQ ID NO: 3222 - DNA, 20 bp, Artificial Sequence
  Synthetic Oligonucleotide
  misc_feature (6)..(6): N is A, T, G, or C
caattncrcgtcttcgwgbt

SEQ ID NO: 3223 - DNA, 21 bp, Artificial Sequence
  Synthetic Oligonucleotide
  misc_feature (6)..(6): N is A, T, G, or C
  misc_feature (20)..(20): N is A, T, G, or C
caattndgyytaagtggcbnt

SEQ ID NO: 3224 - DNA, 20 bp, Artificial Sequence
  Synthetic Oligonucleotide
saattsrygktcttmcrybt

SEQ ID NO: 3225 - DNA, 20 bp, Artificial Sequence
  Synthetic Oligonucleotide
caattsdkyytcttgrsbbt

SEQ ID NO: 3226 - DNA, 21 bp, Artificial Sequence
  Synthetic Oligonucleotide
  misc_feature (7)..(7): N is A, T, G, or C
caattandystaagtbskdtt

SEQ ID NO: 3227 - DNA, 21 bp, Artificial Sequence
  Synthetic Oligonucleotide
caattbkkswtaagtwsbbkt

SEQ ID NO: 3228 - DNA, 20 bp, Artificial Sequence
  Synthetic Oligonucleotide
caattsvbsytcttgksbst

SEQ ID NO: 3229 - DNA, 20 bp, Artificial Sequence
  Synthetic Oligonucleotide
caattdskwstcttswbsbt

SEQ ID NO: 3230 - DNA, 20 bp, Artificial Sequence
  Synthetic Oligonucleotide
  misc_feature (17)..(17): N is A, T, G, or C
caattwbbsbtcttbsnkwt

SEQ ID NO: 3231 - DNA, 21 bp, Artificial Sequence
  Synthetic Oligonucleotide
caattbsswstaagtswbsbt

SEQ ID NO: 3232 - DNA, 20 bp, Artificial Sequence
  Synthetic Oligonucleotide
caattskkystcttsgwbst

SEQ ID NO: 3233 - DNA, 20 bp, Artificial Sequence
  Synthetic Oligonucleotide
caattssykwtcttwbsyst

SEQ ID NO: 3234 - DNA, 21 bp, Artificial Sequence
  Synthetic Oligonucleotide
caattkkkgbtaagtsyssst

SEQ ID NO: 3235 - DNA, 21 bp, Artificial Sequence
  Synthetic Oligonucleotide
caattsydystaagtsghkst

SEQ ID NO: 3236 - DNA, 20 bp, Artificial Sequence
  Synthetic Oligonucleotide
saatttctactvwhgtagat

SEQ ID NO: 3237 - DNA, 22 bp, Artificial Sequence
  Synthetic Oligonucleotide
aaatttctactsvbwygtagat

SEQ ID NO: 3238 - DNA, 21 bp, Artificial Sequence
  Synthetic Oligonucleotide
saatttctactvsbwgtagat

SEQ ID NO: 3239 - DNA, 22 bp, Artificial Sequence
  Synthetic Oligonucleotide
saatttctactshhbygtagat

SEQ ID NO: 3240 - DNA, 21 bp, Artificial Sequence
  Synthetic Oligonucleotide
saatttctactswshgtagat

SEQ ID NO: 3241 - DNA, 21 bp, Artificial Sequence
  Synthetic Oligonucleotide
caattkdkkktaagtsbbdst

SEQ ID NO: 3242 - DNA, 20 bp, Artificial Sequence
  Synthetic Oligonucleotide
caattgkbwdtcttkkssyt

SEQ ID NO: 3243 - DNA, 20 bp, Artificial Sequence
  Synthetic Oligonucleotide
saatttctcctmhhggagat

SEQ ID NO: 3244 - DNA, 22 bp, Artificial Sequence
  Synthetic Oligonucleotide
saatttctactwwbdhgtagat

SEQ ID NO: 3245 - DNA, 21 bp, Artificial Sequence
  Synthetic Oligonucleotide
saatttctccvhmvvggagat

SEQ ID NO: 3246 - DNA, 21 bp, Artificial Sequence
  Synthetic Oligonucleotide
saatttctacthbwsgtagat

SEQ ID NO: 3247 - DNA, 20 bp, Artificial Sequence
  Synthetic Oligonucleotide
caattbwbbvtcttkkbwst

SEQ ID NO: 3248 - DNA, 22 bp, Artificial Sequence
  Synthetic Oligonucleotide
saatttctactwswhygtagat

SEQ ID NO: 3249 - DNA, 20 bp, Artificial Sequence
  Synthetic Oligonucleotide
  misc_feature (6)..(6): N is A, T, G, or C
saattnsksstcttsbdbkt

SEQ ID NO: 3250 - DNA, 22 bp, Artificial Sequence
  Synthetic Oligonucleotide
  misc_feature (12)..(12): N is A, T, G, or C
saatttctccbnbvvbggagat

SEQ ID NO: 3251 - DNA, 21 bp, Artificial Sequence
  Synthetic Oligonucleotide
  misc_feature (13)..(14): N is A, T, G, or C
aaatttctactdnnhgtagat

SEQ ID NO: 3252 - DNA, 21 bp, Artificial Sequence
  Synthetic Oligonucleotide
saatttctactawsbgtagat

SEQ ID NO: 3253 - DNA, 22 bp, Artificial Sequence
  Synthetic Oligonucleotide
saatttctactaswghgtagat

SEQ ID NO: 3254 - DNA, 21 bp, Artificial Sequence
  Synthetic Oligonucleotide
saatttctactbsshgtagat

SEQ ID NO: 3255 - DNA, 20 bp, Artificial Sequence
  Synthetic Oligonucleotide
saatttctactabygtagat

SEQ ID NO: 3256 - DNA, 22 bp, Artificial Sequence
  Synthetic Oligonucleotide
saatttctactwbbwbgtagat

SEQ ID NO: 3257 - DNA, 22 bp, Artificial Sequence
  Synthetic Oligonucleotide
saatttctactwhsghgtagat

SEQ ID NO: 3258 - DNA, 22 bp, Artificial Sequence
  Synthetic Oligonucleotide
  misc_feature (16)..(16): N is A, T, G, or C
saatttctactsbwsngtagat

SEQ ID NO: 3259 - DNA, 20 bp, Artificial Sequence
  Synthetic Oligonucleotide
saatttctactghmgtagat

SEQ ID NO: 3260 - DNA, 20 bp, Artificial Sequence
  Synthetic Oligonucleotide
  misc_feature (12)..(12): N is A, T, G, or C
saatttctactnhsgtagat

SEQ ID NO: 3261 - DNA, 22 bp, Artificial Sequence
  Synthetic Oligonucleotide
saatttctactswbwhgtagat

SEQ ID NO: 3262 - DNA, 21 bp, Artificial Sequence
  Synthetic Oligonucleotide
saatttctactvbwhgtagat

SEQ ID NO: 3263 - DNA, 21 bp, Artificial Sequence
  Synthetic Oligonucleotide
saattkcksctawgtggmgmt

SEQ ID NO: 3264 - DNA, 20 bp, Artificial Sequence
  Synthetic Oligonucleotide
  misc_feature (9)..(9): N is A, T, G, or C
  misc_feature (19)..(19): n is a, c, g, or t
caattbswsgtcttsswbnt

SEQ ID NO: 3265 - DNA, 20 bp, Artificial Sequence
  Synthetic Oligonucleotide
saattsvykytcttrsgyst

SEQ ID NO: 3266 - DNA, 21 bp, Artificial Sequence
  Synthetic Oligonucleotide
saatttctmctawshgkagat

SEQ ID NO: 3267 - DNA, 21 bp, Artificial Sequence
  Synthetic Oligonucleotide
vaatttctmctaskhgkagat

SEQ ID NO: 3268 - DNA, 22 bp, Artificial Sequence
  Synthetic Oligonucleotide
saatttctactvhwsbgtagat

SEQ ID NO: 3269 - DNA, 20 bp, Artificial Sequence
  Synthetic Oligonucleotide
maattbctcctmttggagrt

SEQ ID NO: 3270 - DNA, 22 bp, Artificial Sequence
  Synthetic Oligonucleotide
  misc_feature (16)..(16): N is A, T, G, or C
saatttctacthswwngtagat

SEQ ID NO: 3271 - DNA, 22 bp, Artificial Sequence
  Synthetic Oligonucleotide
  misc_feature (16)..(16): N is A, T, G, or C
saatttctactvbssngtagat

SEQ ID NO: 3272 - DNA, 22 bp, Artificial Sequence
  Synthetic Oligonucleotide
saatttctactvwswhgtagat

SEQ ID NO: 3273 - DNA, 20 bp, Artificial Sequence
  Synthetic Oligonucleotide
saatttctactvhsgtagat

SEQ ID NO: 3274 - DNA, 20 bp, Artificial Sequence
  Synthetic Oligonucleotide
saatttctactbbwgtagat

SEQ ID NO: 3275 - DNA, 22 bp, Artificial Sequence
  Synthetic Oligonucleotide
saatttctcctahbkyggagat

SEQ ID NO: 3276 - DNA, 21 bp, Artificial Sequence
  Synthetic Oligonucleotide
saatttctactsbbwgtagat

SEQ ID NO: 3277 - DNA, 21 bp, Artificial Sequence
  Synthetic Oligonucleotide
caatttctacthhwsgtagat

SEQ ID NO: 3278 - DNA, 21 bp, Artificial Sequence
  Synthetic Oligonucleotide
  misc_feature (8)..(8): N is A, T, G, or C
  misc_feature (18)..(18): N is A, T, G, or C
vaattssnbstaagtksnsst

SEQ ID NO: 3279 - DNA, 20 bp, Artificial Sequence
  Synthetic Oligonucleotide
caattbssvwtcttkbssst

SEQ ID NO: 3280 - DNA, 20 bp, Artificial Sequence
  Synthetic Oligonucleotide
caattgttsdtcttkgaayt

What is claimed is:

1. A function/processing-screening function screening method for identifying one or a plurality of guide RNA (gRNA) molecules that are DNA-binding/RNA-processing gRNA molecules, the method comprising:
   (a) contacting (i) a first Cas protein that binds a promoter sequence that drives expression of a first reporter protein; (ii) a first nucleic acid molecule comprising the promoter sequence and a sequence encoding the first reporter protein; and (iii) one or a plurality of test nucleic acid molecule fragments, wherein the binding of one of the test nucleic acid molecule fragments to the first Cas protein produces a riboprotein complex that binds the promoter sequence, wherein the binding of the riboprotein complex to the promoter sequence alters expression of the first reporter protein, wherein the altering is either a reduction or an increase in expression of the first reporter protein, and wherein the altered expression of the first reporter protein identifies the test nucleic acid molecule fragment as a DNA-binding gRNA molecule;
   (b) contacting (i) a second Cas protein; (ii) a second nucleic acid molecule encoding a second reporter protein; and (iii) an mRNA molecule comprising an RNA polymerase (RNAP) sequence and the sequence of one of the identified DNA-binding gRNA molecules positioned past the 3' end of the RNAP sequence, wherein:
      if the second Cas protein processes the identified DNA-binding gRNA molecule in the mRNA molecule comprising the RNA polymerase (RNAP) sequence, translation of the RNAP mRNA sequence produces a functional RNAP that drives expression of the second reporter protein, and
      if the second Cas protein does not process the identified DNA-binding gRNA molecule in the mRNA molecule comprising the RNA polymerase (RNAP) sequence, translation of the RNAP mRNA sequence produces an RNAP that does not drive expression of the second reporter protein,
   (c) assessing expression of the second reporter protein, wherein the presence of the expressed second reporter protein determines that the identified DNA-binding gRNA molecule is a DNA-binding/RNA-processing gRNA molecule and the absence of the expressed second reporter protein determines that the identified DNA-binding gRNA molecule is not an RNA-processing gRNA molecule; and
   (d) optionally, repeating steps (a)-(c) for an additional one or more of the test nucleic acid molecule fragments.

2. The function/processing-screening method of claim 1, wherein the promoter sequence is a constitutive promoter sequence.

3. The function/processing-screening method of claim 1, wherein one or both of the first and second reporter proteins comprises a fluorescent protein.

4. The function/processing-screening method of claim 1, wherein one or both of the first and second Cas proteins is a Cas12a protein, and optionally is one of: AsCas12a (wild type), LbCas12a, LbCas12a (RR), and enAsCas12a.

5. The function/processing-screening method of claim 1, wherein the first Cas protein, the nucleic acid molecule comprising the promoter sequence and the sequence encoding the first reporter protein, and the one or a plurality of test nucleic acid molecule fragments are in a cell, and the first Cas protein is expressed in the cell, and optionally, a nucleic acid sequence encoding the first Cas protein is delivered to the cell in a vector.

6. The function/processing-screening method of claim 5, wherein the cell is a bacterial cell.

7. The function/processing-screening method of claim 5, wherein the cell is a eukaryotic cell.

8. The function/processing-screening method of claim 1, further comprising,
   (i) repeating step (a) for an additional one or more of the test nucleic acid molecule fragments, and identifying a plurality of DNA-binding gRNA molecules;
   (ii) sorting the identified plurality of DNA-binding gRNA molecules based on a level of the altered expression of the first reporter protein by the identified DNA-binding gRNA molecules; and
   iii) identifying the sorted DNA-binding gRNA molecules with:
      (A) higher levels of reduction of the first reporter protein expression compared to the sorted DNA-binding gRNA molecules with lower levels of reduction of the first reporter protein expression; or
      (B) higher levels of increase of the first reporter protein expression compared to the sorted DNA-binding gRNA molecules with lower levels of increase of the first reporter protein expression.

9. The function/processing-screening method of claim 1, further comprising preparing a gRNA scaffold array comprising:
   a plurality of units, wherein a unit comprises
      (i) the gRNA molecule determined to be a DNA-binding/RNA-processing gRNA molecule and
      (ii) an independently selected spacer sequence, or
      (iii) the gRNA molecule determined to be a DNA-binding gRNA molecule that is not an RNA-processing gRNA molecule and
      (iv) an independently selected spacer sequence.

10. The function/processing-screening method of claim 9, wherein the prepared array of the gRNA scaffold molecules comprises one or more of a unit comprising: one of the identified gRNA molecules and an independently selected spacer sequence and wherein the spacer sequences binds an independently selected nucleic acid sequence.

11. The function/processing-screening method of claim 10, wherein the prepared gRNA scaffold array comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more of the units, wherein the gRNA molecules of the units are independently selected and the spacer sequences of the units are independently selected.

12. The function/processing-screening method of claim 9, wherein the prepared gRNA scaffold array comprises a plurality of the prepared gRNA scaffold molecules comprising the gRNA molecules determined to be DNA-binding/RNA-processing gRNA molecule.

13. The function/processing-screening method of claim 9, wherein the prepared gRNA scaffold array comprises a plurality of the prepared gRNA scaffold molecules comprising the gRNA molecules identified as DNA-binding gRNA molecules that are not RNA-processing gRNA molecules.

14. The function/processing-screening method of claim 1, wherein:
   step (b) comprises contacting (i) the second Cas protein; (ii) the second nucleic acid molecule encoding the second reporter protein; (iii) an mRNA molecule comprising an RNAP sequence and the sequence of one of the DNA-binding gRNA molecules identified in (a) positioned past the 3' end of the RNAP sequence; and (iv) a plurality of mRNA molecules each comprising the RNAP sequence and the sequence of one of a plurality of DNA-binding gRNA molecules that are not RNA-processing gRNA molecules and that are positioned past the 3' end of the RNAP sequence, wherein the presence of RNA-processing identifies the DNA-binding gRNA molecule identified in (a) as a DNA-binding/RNA-processing gRNA molecule.

* * * * *

UNITED STATES PATENT AND TRADEMARK OFFICE
CERTIFICATE OF CORRECTION

PATENT NO. : 12,460,201 B2
APPLICATION NO. : 16/931389
DATED : November 4, 2025
INVENTOR(S) : Mariah Avila et al.

Page 1 of 1

It is certified that error appears in the above-identified patent and that said Letters Patent is hereby corrected as shown below:

In the Claims

In Claim 1, Line 1, please delete "function screening".

In Claim 12, Line 52, please replace "molecule" with "molecules".

Signed and Sealed this
Twenty-third Day of December, 2025

John A. Squires
*Director of the United States Patent and Trademark Office*